United States Patent 9,958,448 (APTAMERS AND USES THEREOF) - sequence listing, part 3

SEQ ID NO: 24988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcgcaccctgctcgatgaggtttcaggg

SEQ ID NO: 24989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcgcccaactacaaataaggtgaggggt

SEQ ID NO: 24990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcgcgcaccttaagccacctttgacctc

SEQ ID NO: 24991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcggaggtgataacgtttaacggggggc

SEQ ID NO: 24992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcggatgtgctggaaaccaatcttaaga

SEQ ID NO: 24993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcggcggaatagagactacagcgatgac

SEQ ID NO: 24994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggcgttactcactccctatttcggtttag

SEQ ID NO: 24995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggctaaccgttaggtcctgccccaaccgc

SEQ ID NO: 24996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggctacgatagcgtggctattcccctgat

SEQ ID NO: 24997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggctagtattgttaatgatttgatgttac

SEQ ID NO: 24998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggctatggacccgcgccggatacataggt

SEQ ID NO: 24999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggctcggaatcggagttcatctgttgctc

SEQ ID NO: 25000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggctctacgttgcagcttccaaggccccg

SEQ ID NO: 25001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggctgaccggtgtgttagcgaagagtcca

SEQ ID NO: 25002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggctgacggttgttatgctgtattcgacc

SEQ ID NO: 25003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggctgcaattgatttcgaaaagctgtgca

SEQ ID NO: 25004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggctgcatcccggtcccatgaactcagtt

SEQ ID NO: 25005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggctgcgtcccttcaaatggcactcgttg

SEQ ID NO: 25006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggctggcgatccaatggtagacgtacgag

SEQ ID NO: 25007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggctggtgggactgcggtagggagcagca

SEQ ID NO: 25008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggctgtacttctcggccgtaccaaatcgg

SEQ ID NO: 25009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggctttaattactttccgacactgctgaa

SEQ ID NO: 25010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggaaggcggagtcgaggtcctaccgcgg

SEQ ID NO: 25011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggacaccagacacgcaaacaacaggtcc

SEQ ID NO: 25012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggacatcttggtgatctcggcagctgtt

SEQ ID NO: 25013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggacgcgtccatcgactggaccataggt

SEQ ID NO: 25014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggacgtgttccatagactgcgctccccg

SEQ ID NO: 25015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggacgtttctaacaaacctcaacattgt

SEQ ID NO: 25016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggagagccttggggtgtcctgttgcgcc

SEQ ID NO: 25017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggaggaggccaagtgcaacggcaccgat

SEQ ID NO: 25018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggaggctgttgaccttgccactcggtgg

SEQ ID NO: 25019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggagtaggcgcaggggttgcaatcaatc

SEQ ID NO: 25020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggatcgaggcgcagtgtgggtacgttat

SEQ ID NO: 25021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggcatcgttatactcgaccggtggctta

SEQ ID NO: 25022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggcccgatgacaaagaacgcacgattgc

SEQ ID NO: 25023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggctacgcagcaagtcgcttggacgcat

SEQ ID NO: 25024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggctcagtagtgataaagcggcagtcct

SEQ ID NO: 25025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggctcgagatgattctgtttaccctcac

SEQ ID NO: 25026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggctgcggagcttgaatgttcccatccc

SEQ ID NO: 25027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggcttgtgtaggcgtccgtggcctagta

SEQ ID NO: 25028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggggaattgattttgacctatcctcttgc

SEQ ID NO: 25029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggggattgcttgctttatcgggtttccta

SEQ ID NO: 25030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggggcaacgctttagccctatcgtgtcgg

SEQ ID NO: 25031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggggcacgggtcgtattgagcatagggaa

SEQ ID NO: 25032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggggggacactgcttgaatgctggttcgc

SEQ ID NO: 25033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggggtagagatcccttgactttattctct

SEQ ID NO: 25034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggggtcaatcgacgaaaggcaagggactt

SEQ ID NO: 25035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggggtttgaccacaatgggttctgctaat

SEQ ID NO: 25036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggtggggcacgatcaagtcatttggtcg

SEQ ID NO: 25037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggtggtcgaagagagcgagaatcgggtc

SEQ ID NO: 25038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggtgtcatctcgtttgatagcatgctat

SEQ ID NO: 25039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggttatcagcgcgttggtttcacgcgtg

SEQ ID NO: 25040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgggttatctcggcaatcagtcggtccgct

SEQ ID NO: 25041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtagcgagggccggttgtaagatagacg

SEQ ID NO: 25042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtagctcaaaatcgaacacggcaggggt

SEQ ID NO: 25043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtaggatcgaagagatgtgttatttgac

SEQ ID NO: 25044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtagtctagtgggaagtcgactgtggag

SEQ ID NO: 25045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtatacgtgtgcttcatggtgtactgct

SEQ ID NO: 25046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtcacccactcgctcttgggttcgcctg

SEQ ID NO: 25047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtcacctctcagaaggctggttgacgca

SEQ ID NO: 25048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtccacacgatacccaaatgacgtaagc

SEQ ID NO: 25049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtccccaatgtagtatggcagggagcgg

SEQ ID NO: 25050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtcgcaggtgatgctgtatcggttgacg

SEQ ID NO: 25051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtcgctatatgtgacggaggttgtgaag

SEQ ID NO: 25052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtcgtcacccagatccgtttgcgtggcc

SEQ ID NO: 25053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtctaggaaaacggcatgcacacgtggg

SEQ ID NO: 25054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtctcggtaattgctgttccgtctgggt

SEQ ID NO: 25055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtgatggcggacgaaggaacggtaaggt

SEQ ID NO: 25056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtgcaggaagtaatcaagctttcaacgt

SEQ ID NO: 25057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtgcggcgggtcttagctgtctggcggg

SEQ ID NO: 25058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtgcggtccaaggctgacccggttgggg

SEQ ID NO: 25059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtgcgttatcaacgttgtccgcccattc

SEQ ID NO: 25060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtgctggagtccagtgaagtgacgcctt

SEQ ID NO: 25061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtgggcaatagttagctgaattccctca

SEQ ID NO: 25062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtgggggacgacagtcgtagagtgttaa

SEQ ID NO: 25063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtgtattcaccgtatccatccgtactgt

SEQ ID NO: 25064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtgtgacgacgacgggagactccctcgt

SEQ ID NO: 25065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtgtgccctccgtccctcggtgtctagt

SEQ ID NO: 25066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtgtggaggcgtagggggcccgggtgca

SEQ ID NO: 25067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggttcagcgctgccctttctcggggattc

SEQ ID NO: 25068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggttcatgcggtattctgccgggccagtg

SEQ ID NO: 25069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggttccaccgcatggcgtattggatcgtg

SEQ ID NO: 25070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggttcgatggtagtgtggagggctcccca

SEQ ID NO: 25071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggttgattacgtatttctcgttgtattcg

SEQ ID NO: 25072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggttgcctacagatacgagtgggtctgcc

SEQ ID NO: 25073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtttgggaaatacgcaatcctcgccgcc

SEQ ID NO: 25074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctggtttgggcgtgttcgagatcgtgcgggc

SEQ ID NO: 25075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtaagaaagatgcgcaaagatggtacgtg

SEQ ID NO: 25076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtaatattggacacggtcaaaaagtccaa

SEQ ID NO: 25077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtacaatccagtggtcattggcgataggc

SEQ ID NO: 25078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtagatttcggttagtatatccgtgactg

SEQ ID NO: 25079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtagcagtacgtgcgaactgctgtgcgcg

SEQ ID NO: 25080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtagcgaatatgatctgttagcgacaacg

SEQ ID NO: 25081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtaggaccgcggtttactggtcacggttc

SEQ ID NO: 25082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtaggaggacctgattagtagcttcggcg

SEQ ID NO: 25083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtaggtcgtgtgcagaggtctcctgcgat

SEQ ID NO: 25084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtagtctaatgctggaggattgcaatgtt

SEQ ID NO: 25085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtagttgcctcgtgctctcactctctgct

SEQ ID NO: 25086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtataggcagtagagaacccttcatcagc

SEQ ID NO: 25087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtatccgccgacgcgctccagaagtgggt

SEQ ID NO: 25088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtatgatccagtgggggccgtggggggcc

SEQ ID NO: 25089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtatggttccggcgtttaaaggaggggag

SEQ ID NO: 25090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtatgtaggtgcgttggtccaacgtccgg

SEQ ID NO: 25091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtatgtagtcgtattcacgtaatctgcgg

SEQ ID NO: 25092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtcacacgtgtaatccaccttgccaaacc

SEQ ID NO: 25093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtcacccgctagagggaatagtgtgcgag

SEQ ID NO: 25094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtcagcgcgcccgtcaatagcatcaagtt

SEQ ID NO: 25095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtcagctgtcgagcgctcacagggatgag

SEQ ID NO: 25096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtcatcaccgtttaagcgaaatgccgcgg

SEQ ID NO: 25097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtcatgtagatgcccagccttttcatatc

SEQ ID NO: 25098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtcatgtgacgcacttcggccaggttgcg

SEQ ID NO: 25099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtcattcgcgtgtgtggcacattcttcgg

SEQ ID NO: 25100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtccaccttggggtgttccgcggaaacgt

SEQ ID NO: 25101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtccatatgtaaggtggaatcctgccgac

SEQ ID NO: 25102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtccccagtgctcttgtgttcagtggatt

SEQ ID NO: 25103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtccgaatagctcttaacccgccttaatg

SEQ ID NO: 25104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtccggatgctcgggtggtttgtgtagtt

SEQ ID NO: 25105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtcctaagtgtatacaagtgtccagccgt

SEQ ID NO: 25106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtcctcggactcctcccgcgtgtgattgg

SEQ ID NO: 25107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtcgctcagcagaacagtggcaattaatg

SEQ ID NO: 25108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtcggaaaagtcatgtcaacaacgccctc

SEQ ID NO: 25109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtcggacggacaatcgacggttctcctat

SEQ ID NO: 25110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtcggatctagcgtcccataaccgatatg

SEQ ID NO: 25111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtcggcgcgacccaataaaggcgggcacg

SEQ ID NO: 25112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtcggtgtgcacgttatgggttgtgaggt

SEQ ID NO: 25113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtcgtgacacaaaaccagccggtccagcg

SEQ ID NO: 25114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtcgttaccatgagaccgacagtcaagga

SEQ ID NO: 25115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtctaccgcgcatgacggtgccgattggt

SEQ ID NO: 25116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtctacgcgcgccgtttaattccgtgttg

SEQ ID NO: 25117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtctgcaagtgatgtggtctttgggttct

SEQ ID NO: 25118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtgacccggcatttggatgcgtggaagcc

SEQ ID NO: 25119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtgacgaacagcggctttgcagtgggatt

SEQ ID NO: 25120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtgactagactatccgatctccacgggga

SEQ ID NO: 25121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtgagcgctcctacggcgggcgtttttat

SEQ ID NO: 25122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtgatcatcgtgattggttttactcgaat

SEQ ID NO: 25123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtgcactacattctaccggagttgcgcgc

SEQ ID NO: 25124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtgcccgggataattcgacgatgacgagg

SEQ ID NO: 25125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtgcggtcgaggtgaacgagtggatgtat

SEQ ID NO: 25126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtgcgtgtttgcctccgcattacattctc

SEQ ID NO: 25127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtggaggttgttgactaggttttgcgttc

SEQ ID NO: 25128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtggatgcgggtatttatggtttgtattg

SEQ ID NO: 25129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtggcatcctgagggtgctatcggggagc

SEQ ID NO: 25130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtggcatgttcccttgtaggtccggctgt

SEQ ID NO: 25131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtggtcccgtgtattatccgggggtcatt

SEQ ID NO: 25132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtggtgaacatagcatcacacccgatgtt

SEQ ID NO: 25133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtggtgcacgcaggacccgggtgaggggt

SEQ ID NO: 25134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtgtagggcaacgttgggttgatactctg

SEQ ID NO: 25135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtgtctgctatgaaagcgtccagcaccgg

SEQ ID NO: 25136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtgtgggggtgcgcagataccatcccctt

SEQ ID NO: 25137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtgttataaactcgtcttacccgccgctg

SEQ ID NO: 25138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtgttggtgagtaacatcacacgcccggg

SEQ ID NO: 25139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgttaaaaggggagcgcactatcgggcatc

SEQ ID NO: 25140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgttaactctgttggctcacaattcgtttt

SEQ ID NO: 25141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgttacctgcgttcagacacgaatcgcgga

SEQ ID NO: 25142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgttcaacgcgggttgagcgaatcgggtcg

SEQ ID NO: 25143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgttcattttgaccgttctagacggaaagt

SEQ ID NO: 25144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgttccatcgaacttctccgatgatttatg

SEQ ID NO: 25145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgttcctcagcagtgctcctaccttcgtac

SEQ ID NO: 25146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgttcgatcccgggtggctcttggcgtctc

SEQ ID NO: 25147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgttcgatccgggttttgtggatacatcat

SEQ ID NO: 25148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgttcgtcagcctggccctgctagtttcat

SEQ ID NO: 25149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgttctgacacagcggattcatccggttcg

SEQ ID NO: 25150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgttgcacttgactatgggagcgttggcgc

SEQ ID NO: 25151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgttggtggcactccactcgtggcttcggg

SEQ ID NO: 25152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgttgtgtacgttcttcgcggattcttgcc

SEQ ID NO: 25153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgttgttgatctccgacctggttgttccgc

SEQ ID NO: 25154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtttactcggattattatgagtagaggcg

SEQ ID NO: 25155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtttactctagaccaatagctacactttc

SEQ ID NO: 25156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtttagctcaggctgtcaactccccggct

SEQ ID NO: 25157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtttgacgaatcatggatccgaacggatg

SEQ ID NO: 25158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtttgatcacgatgacgaaactccgggtt

SEQ ID NO: 25159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctgtttgtatgccgttgaagcagttgttgac

SEQ ID NO: 25160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaaaattttagcatgaatggtggtaggta

SEQ ID NO: 25161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaaacgtcaagcctgccaccacgttaagg

SEQ ID NO: 25162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaaagattatatacgcttttatcttgttt

SEQ ID NO: 25163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaaagttgcaattcgacaaaagagcgttt

SEQ ID NO: 25164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaacagggattctttgcacttctggtgcc

SEQ ID NO: 25165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaacagggtttcttaagctagcacatgcg

SEQ ID NO: 25166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaactaatttgtaagcatgcgataagagg

SEQ ID NO: 25167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaagaggctatatctgttggctcggactc

SEQ ID NO: 25168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaagccagtacacgagtagtgacacccca

SEQ ID NO: 25169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaagcgtttttctagcccaattctgtgcg

SEQ ID NO: 25170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaaggacctcggtgggttttaagggcggc

SEQ ID NO: 25171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaagttgagggttagtgtttatggagctt

SEQ ID NO: 25172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaatcagtgcgacttcacccggcagggag

SEQ ID NO: 25173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaatccctcggatgcaccattgttggttc

SEQ ID NO: 25174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaatgtataagcctccctgatttgaatac

SEQ ID NO: 25175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaattcctgtctttttctacgcctggtca

SEQ ID NO: 25176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttacacaacttagcgggcatgcagtcgtga

SEQ ID NO: 25177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttacacgaagtcctttaggcagttttcctg

SEQ ID NO: 25178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttacagcgcatcacaagaaatgttggttta

SEQ ID NO: 25179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttacagtatgctaggattcgggtgcaatta

SEQ ID NO: 25180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaccggaccgagcggaccgtatgagtagc

SEQ ID NO: 25181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttacgaatgcttcagtaggtaatcttgtgt

SEQ ID NO: 25182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttacgtcttgtggtgtattgcccgtttcat

SEQ ID NO: 25183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttacgttagccggaataacgtttgactcct

SEQ ID NO: 25184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttactaacacctcgatatgtgatccggttg

SEQ ID NO: 25185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttactcgtaggtgacaaagcacgccattag

SEQ ID NO: 25186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttactgagttgtgcacttgggagtagcgga

SEQ ID NO: 25187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttactgcatgcctcgaccctcctgacgcgc

SEQ ID NO: 25188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttacttgagggtccaagccctgcagcgtgg

SEQ ID NO: 25189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttagaggacgtggcgcaatgcttgatactg

SEQ ID NO: 25190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttagcatggcggagctgccgttcccgagga

SEQ ID NO: 25191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttagccagtttatctcttcttgacgctgtt

SEQ ID NO: 25192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttagcgccaacttactatcctcacaggtcc

SEQ ID NO: 25193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttagctagtagccggctcacatccgaagaa

SEQ ID NO: 25194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttagcttgtttattcttcacctggtcgtct

SEQ ID NO: 25195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaggatcgcttgtatgaaaagttggattt

SEQ ID NO: 25196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaggcgcggtatttgtcgtatacggagtc

SEQ ID NO: 25197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttagggtaccgcgtgaaccattttgatccc

SEQ ID NO: 25198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttaggtattcataggttgtatcgcttccgg

SEQ ID NO: 25199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttagtgctagattatctgcttactcggata

SEQ ID NO: 25200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttagtggcaccttattttggaacgccatgg

SEQ ID NO: 25201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttagtttacattgaatcgtaatcggactag

SEQ ID NO: 25202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttagttttcaaaactgttgggattagttag

SEQ ID NO: 25203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttatatcaacagatttttattgcgcgatga

SEQ ID NO: 25204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttatatcagttagttgtaccttcgtgttcc

SEQ ID NO: 25205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttatattatacgccggaagctctttagaat

SEQ ID NO: 25206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttatcaggatctgccgaaaccgcgatacgt

SEQ ID NO: 25207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttatcgagcgacttacgtgagctttccttg

SEQ ID NO: 25208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttatcggcagctgtagaggggggccaatcc

SEQ ID NO: 25209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttatcggtgaaaagcgtaccaactggtcga

SEQ ID NO: 25210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttatcggttcgcgggagcgctggaggaggc

SEQ ID NO: 25211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttatctagggtaggacgcgcaaaggactca

SEQ ID NO: 25212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttatgcacttgccatcgaatttaatcaatt

SEQ ID NO: 25213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttatgcatactgcggctttgtgtttggtgg

SEQ ID NO: 25214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttatgctggttgtcagggatgtaacagttg

SEQ ID NO: 25215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttatgttagctcacctgcgcataaatcggc

SEQ ID NO: 25216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttattacgttcagtgtaaagcctttcaacc

SEQ ID NO: 25217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttattagttgccagttttgcatctggtaac

SEQ ID NO: 25218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttattcccgagacgatttcgttggtgggtg

SEQ ID NO: 25219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttattctaaactcgctcagagatcggcgtg

SEQ ID NO: 25220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttattgataactgttggaaggtggtttctg

SEQ ID NO: 25221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcaaagatcgcagtggtgctagaggaacg

SEQ ID NO: 25222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcaacagcgacaccgcaagaacgatgtgc

SEQ ID NO: 25223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcaagccgccaggaccagcgtatagaaga

SEQ ID NO: 25224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcaatgcggtgataaaggactaaacatat

SEQ ID NO: 25225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcacacagggacggtctagcaccgggtag

SEQ ID NO: 25226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcaccatcttgttatccggatcttaataa

SEQ ID NO: 25227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcacgctcgtgggcagtatctgtttgagt

SEQ ID NO: 25228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcacgtcatatcattggagcttcgcaggc

SEQ ID NO: 25229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcactcactcacgattcctctttggggcg

SEQ ID NO: 25230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcaggtgggtacaatgttgggtggtgggg

SEQ ID NO: 25231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcagtaactgacaatccgtgtcgtgcact

SEQ ID NO: 25232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcagttttcaggtatctggatgcacggcc

SEQ ID NO: 25233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcatccgttgcacgtctgagtggaaattc

SEQ ID NO: 25234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttccaacgctgatcacccaatcgctcaccg

SEQ ID NO: 25235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttccacggttcacgttcggtcaatcgtcga

SEQ ID NO: 25236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttccatgcgctcacaagttggacagtgatc

SEQ ID NO: 25237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcccagacgtgcagaaatcctcctggtcc

SEQ ID NO: 25238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcccagtccaggttgggaatagaggtctc

SEQ ID NO: 25239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttccccaatgcacatatggagctgcgggct

SEQ ID NO: 25240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttccccctcgggttaacgtgcaacccatcg

SEQ ID NO: 25241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttccccgaccaacttgagttttgtgtccac

SEQ ID NO: 25242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttccccgccgcctacatcgtgcccctttgc

SEQ ID NO: 25243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttccgaggttcgtactgtgagtagcgacca

SEQ ID NO: 25244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttccgcggtttccaaagctgttagtgcggc

SEQ ID NO: 25245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttccgctgcggcaaagcacgttcccttatt

SEQ ID NO: 25246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttccggacccgcaatgaccaggtggtatgg

SEQ ID NO: 25247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttccggaggggcagacgttccatcatatcc

SEQ ID NO: 25248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttccgggtattacgccggtgctggtgaacg

SEQ ID NO: 25249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcctatgattaactattccgggggcttga

SEQ ID NO: 25250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcctcaaacatgcagttatagcgtctgcg

SEQ ID NO: 25251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcctcggacaccaggactgtttgggggga

SEQ ID NO: 25252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcctgtgtcctcgtaatgcacagaggaac

SEQ ID NO: 25253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcgaagcctgcccggttcaatcgccagct

SEQ ID NO: 25254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcgagcagcttagtttctccgtcaaaggg

SEQ ID NO: 25255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcgagtccggtctcgtcgattctgcgccc

SEQ ID NO: 25256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcgatcttaaccataggagctcaatagaa

SEQ ID NO: 25257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcgattttgtagtctaagtgtgtgggtct

SEQ ID NO: 25258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcgcaaagcgcatcaagcttgacttcggc

SEQ ID NO: 25259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcgcactgatttaacaaattggtaagtga

SEQ ID NO: 25260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcgcattcaaacaggcgaatctacacttg

SEQ ID NO: 25261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcgccatatgactgcatgcccccgccaca

SEQ ID NO: 25262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcgccgcaccctcctgactgccattgcga

SEQ ID NO: 25263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcgcgaatggtcgcacaagagttgctcgt

SEQ ID NO: 25264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcggcagctgacggtaccttaataccagc

SEQ ID NO: 25265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcgggggcttgcaatccgctgctttggga

SEQ ID NO: 25266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcgtaccctctcactgtatcctgcccgac

SEQ ID NO: 25267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcgtctttgttccgtcctttttgcgtgac

SEQ ID NO: 25268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcgtggacaggtatctgctatggcgtgga

SEQ ID NO: 25269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcgtgtgtatactgcccaaggtgccccct

SEQ ID NO: 25270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttctaaagcaggaggtggcgagatggtttg

SEQ ID NO: 25271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttctacaagcactttcactagctcgcttgc

SEQ ID NO: 25272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttctagaagagctcgaggtttagggtgtgc

SEQ ID NO: 25273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttctagtctctgcaaacgctaacgccatgc

SEQ ID NO: 25274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttctatatccgccagcccggtctgccggag

SEQ ID NO: 25275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttctatcggtacgggtgttaagccttaact

SEQ ID NO: 25276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttctatggcagcactccaacagttcagggc

SEQ ID NO: 25277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttctcgatcgtggccggcatacatcggtct

SEQ ID NO: 25278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttctcgccaagctcaccggcagtggggtta

SEQ ID NO: 25279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttctgcaattcgaatctaaccgcgacgtcc

SEQ ID NO: 25280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttctgcttgcctccttgcgtctctgttgtc

SEQ ID NO: 25281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttctgttgggtattgtaggggatgcgggtc

SEQ ID NO: 25282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcttatggggttagacattcttgctttgt

SEQ ID NO: 25283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcttgctctttcggatgttcatttgcccc

SEQ ID NO: 25284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttcttgtacgtcctttcacaatttggcgag

SEQ ID NO: 25285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgaaaaagctggtccattgtcccccgcat

SEQ ID NO: 25286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgaaacaacgccccggcaactgtagtggg

SEQ ID NO: 25287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgaaagacgctattagtgttccgttacgc

SEQ ID NO: 25288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgaagtgcttaaagcgcgtagtggagtgg

SEQ ID NO: 25289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgacacggacagcgagaggtcagtcgaag

SEQ ID NO: 25290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgaccacgtgcaggatcagaacgggaggt

SEQ ID NO: 25291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgactcgctaaggtataagttcacctgcc

SEQ ID NO: 25292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgacttaacccgtgtagagttagatttgt

SEQ ID NO: 25293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgacttaatcgagatcccacttgaggtcc

SEQ ID NO: 25294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgagcgacacggtcctttagtaatcgtgg

SEQ ID NO: 25295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgagctgttggagggcgtttacaagctgt

SEQ ID NO: 25296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgaggaggctcggcatgctacggaatcta

SEQ ID NO: 25297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgaggtctttctgaaaaatacttgcttgc

SEQ ID NO: 25298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgagtaaatacggaccgaggaagtcgtcg

SEQ ID NO: 25299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgatagaagtccggatgttcggatcgttt

SEQ ID NO: 25300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgatagtgcgacaggcgtcacgtaggttg

SEQ ID NO: 25301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgatccggtaacagggctgtatcatgcac

SEQ ID NO: 25302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgattttatatagcatgatatctgcgatg

SEQ ID NO: 25303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgcaacaaatcatgctcggatacacgggg

SEQ ID NO: 25304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgcaacacgacttatgttgtttggcgggg

SEQ ID NO: 25305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgcacgtttcacatgtgtcacggaatgcg

SEQ ID NO: 25306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgcacttgtattgatcgctggggcaatcc

SEQ ID NO: 25307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgcagcatgcctgcagactgttgggtagt

SEQ ID NO: 25308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgcagttggcgtctggcgcgtacgtggcg

SEQ ID NO: 25309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgcccagcgcaccatcgtgtggacggtag

SEQ ID NO: 25310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgcctcgactaatctttgcagcatggatc

SEQ ID NO: 25311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgcgctatcgatcggtcgcggacctctgt

SEQ ID NO: 25312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgcgctctggatgagactggtaggtcatg

SEQ ID NO: 25313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgcggcttagtctgatactcgaatgtttc

SEQ ID NO: 25314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgcgtctaggtgtttagttggcagcatgt

SEQ ID NO: 25315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgcgtgctgcacctgtgtcagactggttg

SEQ ID NO: 25316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgcgtggttgcatcggcgtgtacgtgcgg

SEQ ID NO: 25317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgctgctctgtgtccagtgccttaggatt

SEQ ID NO: 25318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgcttagcatcgagtggctggattttgtt

SEQ ID NO: 25319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgcttcaattcagaccgtccctccaatga

SEQ ID NO: 25320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgcttgggtgccggtgcaatcgcaactcc

SEQ ID NO: 25321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggaactctccgtacgaagctttggcacg

SEQ ID NO: 25322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggaagaccagtagacacggccggctcgc

SEQ ID NO: 25323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggattaagtctcggtcggatggcgtgga

SEQ ID NO: 25324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggcaacatgttgtcggcgaacaggcctt

SEQ ID NO: 25325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggcaccgtaaagcacgggaggaacatat

SEQ ID NO: 25326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggcgggtccaagctcaccatatcaggac

SEQ ID NO: 25327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggcggtaccgtagatggcgctatttgac

SEQ ID NO: 25328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggcgtcttcgagagcacgctagcaacat

SEQ ID NO: 25329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggcgtttgggctggaacacaatcacccg

SEQ ID NO: 25330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggcttcggtccggccgtgatcgcagcgc

SEQ ID NO: 25331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgggagcggtagtccagcgtgctcacccg

SEQ ID NO: 25332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgggcaccgcaactccaacccaacgtgtt

SEQ ID NO: 25333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgggcatggggcagtttcgggtttatagt

SEQ ID NO: 25334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggggaccagtttcacacggtttgtgtct

SEQ ID NO: 25335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggggatgctatttccagacaggattatt

SEQ ID NO: 25336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggggtagggtactgtcacgcctcgtgtt

SEQ ID NO: 25337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgggtttacatgtgggggtgttcaaagct

SEQ ID NO: 25338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggtaaaatacacatcttccaactttggt

SEQ ID NO: 25339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggtactgtacatcactatttgaacaggt

SEQ ID NO: 25340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggtatatcacattgcatgagcttccacg

SEQ ID NO: 25341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggtcaaatccgacccaggtcagaggagg

SEQ ID NO: 25342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggtctcgaacgcaggatttgtggctttg

SEQ ID NO: 25343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggtctgcggacatgcctcgacgtttggc

SEQ ID NO: 25344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggtgcgggcacggtatgcttcacagctt

SEQ ID NO: 25345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggtgcggtgacctgccagtcacgatgca

SEQ ID NO: 25346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggtggcgttgtaattggagcgtaccggt

SEQ ID NO: 25347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttggttcgcacgcatctgttggaactccgc

SEQ ID NO: 25348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtaaatgcattgatattcatttagcgtt

SEQ ID NO: 25349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtaaccagatgcataatgaatgccgtcc

SEQ ID NO: 25350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtaacgcagcgcagccggttcgtgatgt

SEQ ID NO: 25351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtagcgatgcagaccgtgcgcagcaggg

SEQ ID NO: 25352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtagtaccaggaatttcgcccgttgggt

SEQ ID NO: 25353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtatgatgaaggggcgtttcatgagact

SEQ ID NO: 25354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtatgggcggtaacaagatcccgtagta

SEQ ID NO: 25355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtattcggtttcgcttgggtcttaaaga

SEQ ID NO: 25356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtcactaatccaaagtgtgactcataat

SEQ ID NO: 25357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtcgctctacaaacgggtctatcctggg

SEQ ID NO: 25358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtcgctctaccgcggcggagaacctatt

SEQ ID NO: 25359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtcggtatacgctatctaataatcctgg

SEQ ID NO: 25360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtcgtctgagagctatggacttcaaggg

SEQ ID NO: 25361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtctctcacctagggaggacgtccgtcg

SEQ ID NO: 25362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtgcaaggagtgcagacgacagccccgt

SEQ ID NO: 25363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtggcggctaatgttaacgtgatcctga

SEQ ID NO: 25364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtggggacggtaaactcggtatcatccg

SEQ ID NO: 25365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtgtggggcggcgcatcaccggaagcgc

SEQ ID NO: 25366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgttcagataggtttgggtggtgggtcgg

SEQ ID NO: 25367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgttcctagggcgttggtatgactgctgc

SEQ ID NO: 25368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgttggagacgtggctacgctattctttg

SEQ ID NO: 25369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtttcaggtttaattccccggggaccaa

SEQ ID NO: 25370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttgtttgtcgtgcccgcgtcaccggaaatg

SEQ ID NO: 25371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttaactaaatacccacacgtggtgaagat

SEQ ID NO: 25372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttaagcggaccccaatcgtccttccagta

SEQ ID NO: 25373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttaatccagctgttcttaacttatgtgag

SEQ ID NO: 25374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttaatgtgcgagtgtggtctctttcccgt

SEQ ID NO: 25375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttacagcaggaataatcaatgtatgtccc

SEQ ID NO: 25376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttacggttcgtatttcgttctgtgctttc

SEQ ID NO: 25377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttagacacgcattgtttcgcagacgtccg

SEQ ID NO: 25378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttagacacgtcccgtattgaacctgtctc

SEQ ID NO: 25379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttagcagtccgattacgcccctcgtagtc

SEQ ID NO: 25380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttagccgcagcatcactggcggcctttgt

SEQ ID NO: 25381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttagcgactgtcaccctgcggttcaatac

SEQ ID NO: 25382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttagcggtggaggtcggcggccctggcta

SEQ ID NO: 25383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttagcggttggttttgacgaatcctgggg

SEQ ID NO: 25384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttaggctctggaatggttgggccgctagg

SEQ ID NO: 25385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttaggtaatatcccccacgctctgttgtg

SEQ ID NO: 25386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttagtaagatattggctcttgcagtaagg

SEQ ID NO: 25387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttagtgggctgacggtctaagtcggaggg

SEQ ID NO: 25388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttagtttttcgcgtgatatacccgagtac

SEQ ID NO: 25389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttatatggtgtctgcgatttaaggactgt

SEQ ID NO: 25390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttatcggttgtagtaagagataatcttca

SEQ ID NO: 25391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttatcgttattctatgggcgctagtattg

SEQ ID NO: 25392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttcaaacatctgtccacagagggcgttgg

SEQ ID NO: 25393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttcaatagtaggcagttaagttatccttg

SEQ ID NO: 25394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttcaattgctgccttgttacctgtttgac

SEQ ID NO: 25395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttcatacgggacgtcagacgaggagaatg

SEQ ID NO: 25396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttccattctgattgtggttttggagattt

SEQ ID NO: 25397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttcccaggtgtcgacttcttggtcacgtg

SEQ ID NO: 25398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttccgcccatgacgtgtggcgcgtggagt

SEQ ID NO: 25399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttcgaaaacggctccggtcttgacatccc

SEQ ID NO: 25400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttcgactaaggatccgataccttccgtat

SEQ ID NO: 25401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttcgactggacaggcacccgactccggtg

SEQ ID NO: 25402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttcgatgatcacgagaaaacggttcgtcc

SEQ ID NO: 25403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttctctctggtacgtgtgaaatgtgtgcg

SEQ ID NO: 25404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttctgttttaggttggcgctgactatccg

SEQ ID NO: 25405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgaccgataggcggggtggtggggtgcg

SEQ ID NO: 25406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgacgagactcaattggttaggcacgca

SEQ ID NO: 25407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgacgagctaccctggcccccggatttg

SEQ ID NO: 25408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgacgatgcagtcttaactatgttgccg

SEQ ID NO: 25409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgactgcgttaacttgcaccggaggctg

SEQ ID NO: 25410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgcagaaggtggcgcagttcggcacgct

SEQ ID NO: 25411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgcagggaaaccgtatgagttgagggtg

SEQ ID NO: 25412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgcatcgaacgtattcgtagagatttga

SEQ ID NO: 25413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgcgctggtgaaccgtgtggcaccattg

SEQ ID NO: 25414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttggcagtagagtagatcacgtttatatg

SEQ ID NO: 25415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgggatgactcttcacactagtcagggt

SEQ ID NO: 25416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgggattggcctggagcacatccagcgg

SEQ ID NO: 25417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttggggaacggaatctcgaattttgggta

SEQ ID NO: 25418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgggggaacgggcttccggatcgggtga

SEQ ID NO: 25419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttggtagacactcggcccaagctttctgt

SEQ ID NO: 25420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttggtgatgcccgtatacgtagttataag

SEQ ID NO: 25421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgtaatctccgacgctcctgtctctctc

SEQ ID NO: 25422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgtgcacgcatgaacagttattcctcgc

SEQ ID NO: 25423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgtgccacgtgcccgatactgctcggac

SEQ ID NO: 25424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgtgcctgcttgtcttacgccttggtcg

SEQ ID NO: 25425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgtgtgcatttgcaaagatcggcacgat

SEQ ID NO: 25426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgttgcacttcgtatatagccagggtgt

SEQ ID NO: 25427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttgttttggatgatgactgatttcctcct

SEQ ID NO: 25428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttttaaactggccgacgcgggaggtgaagc

SEQ ID NO: 25429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttttaactcgcgttccgtgaagtcgactcg

SEQ ID NO: 25430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttttaagtaaggagtgtgcagcgagtgttg

SEQ ID NO: 25431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttttacgtgattgtgagatatcttaccgtc

SEQ ID NO: 25432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttttagcttagttttattttctatttctat

SEQ ID NO: 25433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttttccgccattctaatcccaacgatattt

SEQ ID NO: 25434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttttccgtgggcaacaagacccgaggttcc

SEQ ID NO: 25435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttttcctcaacaggggttgacacagtgtga

SEQ ID NO: 25436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttttcgcacgtctggtgggtctcgcgagtg

SEQ ID NO: 25437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttttctcgagacgttgatttggtggaaggt

SEQ ID NO: 25438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttttcttgtattaattgctctggtctctgc

SEQ ID NO: 25439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttttgagcctggtccagcccggaagtaatc

SEQ ID NO: 25440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttttgcactatagttttctcggttgttcct

SEQ ID NO: 25441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttttggaatgttgaaatcaaagacgcggcg

SEQ ID NO: 25442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttttggccagcgcgtaactaggctatggat

SEQ ID NO: 25443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttttgtatggacctagcgtacggcatccgt

SEQ ID NO: 25444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttttgtcgaccgcatagcatcggttcgtat

SEQ ID NO: 25445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ccttttgttgataatctgacgtcatgcgtttc

SEQ ID NO: 25446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttttaccatagagtttggtttaggcatat

SEQ ID NO: 25447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cctttttatgtttgggccttaaacgggtctga

SEQ ID NO: 25448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaaaacttaggcactaaacaacgattctcc

SEQ ID NO: 25449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaaaagtatcggtaataatcagattatcgg

SEQ ID NO: 25450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaaacttagcccgcagtgtggacatgccgg

SEQ ID NO: 25451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaaagcggggtcgcactgacgtcttgaggt

SEQ ID NO: 25452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaaagtgtctgagttcgaaccgggacagca

SEQ ID NO: 25453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaaatgggaagctgctccagtcaggcaagg

SEQ ID NO: 25454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaaattgtttggccagttcacgccggtacg

SEQ ID NO: 25455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaacaagcgcccacctcagcgattttgcgt

SEQ ID NO: 25456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaacacagctgaaggtggaccggcgttgta

SEQ ID NO: 25457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaacagtgcatctccctgccacgcgtcaac

SEQ ID NO: 25458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaacataatgccaactttatgttactaggg

SEQ ID NO: 25459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaacatgttgcaggtgagtgtgccgccgtg

SEQ ID NO: 25460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaacccgcgactagtgtgacaccggcctcg

SEQ ID NO: 25461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaaccgattggtgtaaggaggacgatccgc

SEQ ID NO: 25462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaaccgtagagcatctatggtcgccagcgg

SEQ ID NO: 25463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaacctcgcgctagcgccctgacagtcggg

SEQ ID NO: 25464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaacgagcccttttcttccctgcacggcgc

SEQ ID NO: 25465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaacgagtcatcaacactgcggcacctaca

SEQ ID NO: 25466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaacgcacacgacgctgcggacccctcccc

SEQ ID NO: 25467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaacgggtcaaacaggagcagtttttgttt

SEQ ID NO: 25468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaactattgtagggcattatcgtctctatg

SEQ ID NO: 25469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaactcggcggtgaggggcggtgacgcaca

SEQ ID NO: 25470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaagagtgttgcggttattctatgttaggg

SEQ ID NO: 25471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaagagtttggcgattcgagacagctgcct

SEQ ID NO: 25472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaagcacaggtgaaccgcctaggctagggt

SEQ ID NO: 25473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaagcagcgtgatcgtcgcaaagttcagag

SEQ ID NO: 25474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaagcatgcctcctcacttatgcctgctgg

SEQ ID NO: 25475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaagctcagcgtacaatcgttcgaactaga

SEQ ID NO: 25476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaagctcagctcacttccaggctccccgcg

SEQ ID NO: 25477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaagctgatctttacttctagtgtgcaacc

SEQ ID NO: 25478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaagctttgtagagagggagcgcgtcccgt

SEQ ID NO: 25479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaaggaactagagatcattcgttcgggtct

SEQ ID NO: 25480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaaggataacttttgaccatgaatacggag

SEQ ID NO: 25481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaaggattttgatgagggtgagttatctat

SEQ ID NO: 25482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaaggcattgttgcagtctgcgtgtgttcg

SEQ ID NO: 25483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaaggccgtgaagctaacgcggtgggatgg

SEQ ID NO: 25484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaaggcggtggtggcaggctcgcacgggag

SEQ ID NO: 25485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaaggcgtgtacaagagttaggctgttacc

SEQ ID NO: 25486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaagtcaagcatagtaccggtagatttctc

SEQ ID NO: 25487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaagttctgggctctggctgccaccttccg

SEQ ID NO: 25488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaataaagtagcttcaagtttacatttgca

SEQ ID NO: 25489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaatacaaaaatagcaggatacatgcttgt

SEQ ID NO: 25490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaatactgttcagtcaaatgtagcgttcgc

SEQ ID NO: 25491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaataggcacaacccaggggataggtggag

SEQ ID NO: 25492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaatcacatacggatgcgaaaaatagtcgc

SEQ ID NO: 25493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaatccacggttaatgcggctgctgaggtt

SEQ ID NO: 25494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaatccatcagtgcgatgttatgctgactg

SEQ ID NO: 25495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaatctacaggatttgctccggctccctcc

SEQ ID NO: 25496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaatgctcttcagtattgaattccgcaggg

SEQ ID NO: 25497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacaaaaacagctctgattctgcatttgca

SEQ ID NO: 25498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacaatcgggctggggctgattggtcacat

SEQ ID NO: 25499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacacaattctttcagccttacgattgacg

SEQ ID NO: 25500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacaccactcagcggtcctctttatgctcc

SEQ ID NO: 25501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacagaagactgcattagacacgttacagt

SEQ ID NO: 25502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacagacgaaaagcacgtaagcaccaaact

SEQ ID NO: 25503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacagatatatgtgccaatacgcatggttt

SEQ ID NO: 25504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacagcccgctcggagttccgtatgacggg

SEQ ID NO: 25505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacagcgtaccctcaggcagtgattattcg

SEQ ID NO: 25506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacaggcaaaacatgacgagcgttaaagcg

SEQ ID NO: 25507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacaggtccttcatggaccaaggtggtctg

SEQ ID NO: 25508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacaggtgagagaataacacaagtacgtgg

SEQ ID NO: 25509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacatactcccacggttaatatttcggtgt

SEQ ID NO: 25510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacatagataggtgggttcacttttctatc

SEQ ID NO: 25511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacatcgggtccaacgtttagcattccggc

SEQ ID NO: 25512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacatgcgatcttgttttgtttatgcgttt

SEQ ID NO: 25513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacatggcgcttctccgccgccggcgtaac

SEQ ID NO: 25514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacattgcgtatgtgcatccgggctgttga

SEQ ID NO: 25515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaccacagaggattcgttgccctgcccagg

SEQ ID NO: 25516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaccagagtgggatcgatgagtgtgacgtt

SEQ ID NO: 25517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaccagcagaacgctatccaaattgtgctg

SEQ ID NO: 25518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacccttgttatcttgtttctgaataggat

SEQ ID NO: 25519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaccgctcagctgaacttacgtcggaatag

SEQ ID NO: 25520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaccgctcctgctggtacccccggtaaccg

SEQ ID NO: 25521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaccggacgattcattatcctctggtcctt

SEQ ID NO: 25522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaccggccaacttactgaagagagttgcac

SEQ ID NO: 25523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaccggcggcgagggcagccagtctggggc

SEQ ID NO: 25524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaccgggtgtgctaagtctatccgaaggtt

SEQ ID NO: 25525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaccgtcgcgtttacgcgcagaacgtctcc

SEQ ID NO: 25526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaccgtgcgtctttattccccttccagccc

SEQ ID NO: 25527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacctagtgaggcaggttagctcgtgggat

SEQ ID NO: 25528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacctatttattgaaatgtaatcgttccgt

SEQ ID NO: 25529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacctggcatccggcagtagctggttccca

SEQ ID NO: 25530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacctggccagtcccgtctttaatcaggtc

SEQ ID NO: 25531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacctgggccttattgcgggcgcgaggtca

SEQ ID NO: 25532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaccttcacttatgctgtcgcgtacctcgg

SEQ ID NO: 25533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacgaactcggtaacaatatgatacgcatt

SEQ ID NO: 25534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacgaatgaccctcatgcacaaccggcgca

SEQ ID NO: 25535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacgagagcgggctgactgccacagtggcc

SEQ ID NO: 25536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacgagcgcagacccaggttcgagctagtt

SEQ ID NO: 25537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacgatgacatgtgtatgatttcgcccagg

SEQ ID NO: 25538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacgatgcgataggtttgaattggcacacg

SEQ ID NO: 25539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacgcacattcgttgatttgagactcgcta

SEQ ID NO: 25540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacgcgaggccctattgcgtctacacacgc

SEQ ID NO: 25541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacggagttggcaacgtttgcacacgggaa

SEQ ID NO: 25542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacggatcccgagggaagtaatagcgcgga

SEQ ID NO: 25543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacggcttattcgcgtttttgggatgagtg

SEQ ID NO: 25544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacgggagcgacacactcccagacttcgtc

SEQ ID NO: 25545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacgggccaaatcggcgtcgaaccgtgtcg

SEQ ID NO: 25546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacggtcggtatcgagacggcgccttgtcg

SEQ ID NO: 25547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacgtacgagaagaattcaaaactggcgtt

SEQ ID NO: 25548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacgtaggagagcagttagctcgggcctcg

SEQ ID NO: 25549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacgtaggggcccggcaagccagcagcgca

SEQ ID NO: 25550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacgtctatgggagctggtctgcccgtttg

SEQ ID NO: 25551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacgtgtctatcccgtcttgttggtggctg

SEQ ID NO: 25552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacgttcaaccatccggcctttatgaattc

SEQ ID NO: 25553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacgttgaacaggctaccctctttcccgat

SEQ ID NO: 25554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacgttggtggcttctcatactccccgcgg

SEQ ID NO: 25555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactaaacagcgatcaaatggacgtggcgc

SEQ ID NO: 25556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactaacgcatttcccgggcagctctccaa

SEQ ID NO: 25557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactaagcgagaatcatagtaatggcgaca

SEQ ID NO: 25558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactacatggcttaagtttgcaggctcgat

SEQ ID NO: 25559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactatacgtcgggttgcaagttgtgagtg

SEQ ID NO: 25560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactcatacggtacaggcttcgtctatcgc

SEQ ID NO: 25561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactcatgacgtagaggttggttgggtagc

SEQ ID NO: 25562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactcccatggtagtgacgttgctattccg

SEQ ID NO: 25563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactcccgggtatcaaatacgtcttgcggc

SEQ ID NO: 25564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactcgaatctgtgcatttttaagcgaatg

SEQ ID NO: 25565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactcgagcaacctattacgttgttctgct

SEQ ID NO: 25566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactctgagaggtgcaatatgcttgtgccc

SEQ ID NO: 25567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactctgctagatatgtggatccttcttga

SEQ ID NO: 25568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactgataggcgtcactatgtgaagggccc

SEQ ID NO: 25569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactgatgggcggcaagggtaacgtgacga

SEQ ID NO: 25570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactgcatatttcttgactcatcaatggcc

SEQ ID NO: 25571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactgcccggcggggactaaatccatatgc

SEQ ID NO: 25572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactgcggcaggtttagtgcgtcactttgg

SEQ ID NO: 25573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactgcgggtatcttgtgaccgtaacgtcc

SEQ ID NO: 25574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactggcggatggtggattacacttactgg

SEQ ID NO: 25575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaactgggtcaaaacacatcttggtacctgc

SEQ ID NO: 25576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacttcattggtttgggcgggtccttgtgt

SEQ ID NO: 25577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacttccgtcagcacgcctcggtgtacgca

SEQ ID NO: 25578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaacttgacaagagtacttgccattagttta

SEQ ID NO: 25579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagaactaactgcttttggcggacccactc

SEQ ID NO: 25580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagaatcgcgtcaccagtcccggtgaccta

SEQ ID NO: 25581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagaatgactccgaggacatgcgttttgcc

SEQ ID NO: 25582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagaccaaaggctaggctcatgatgcggca

SEQ ID NO: 25583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagaccgtcaggaactgtacgctagggctt

SEQ ID NO: 25584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagagcaggtgaaatttggaggtgggtgat

SEQ ID NO: 25585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagagcgtccggctgtggcaatcccatggg

SEQ ID NO: 25586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagagctgtttaagcgatccaacgtgtgcc

SEQ ID NO: 25587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagatcgatggaggaattgcgactgccacg

SEQ ID NO: 25588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagattgcccctaagtccttcggcgaattt

SEQ ID NO: 25589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcaaccttgatcggcgctaagcattagt

SEQ ID NO: 25590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcaactgcactcagaacgaaacgggtta

SEQ ID NO: 25591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcaccaattgccgtcttcgtgcatactg

SEQ ID NO: 25592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcactatctctcgggccgacgagtgggt

SEQ ID NO: 25593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcactcataatgattggctctggatggg

SEQ ID NO: 25594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcagcatcggttcacggaacgggaaggt

SEQ ID NO: 25595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcaggcgaagagtaaggaccgcggtgat

SEQ ID NO: 25596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcagggtgacctcccgtttcgtggccga

SEQ ID NO: 25597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcatccatcgtttcacggttcttgtcgt

SEQ ID NO: 25598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcattctcctcatgaatcctcgctgccg

SEQ ID NO: 25599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcccccctcattgcctatcgagttagga

SEQ ID NO: 25600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagccgttggccaaacatgcggatgtagag

SEQ ID NO: 25601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcctgcgaacgtctggcctaaggtgcgg

SEQ ID NO: 25602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcgaacactaacgcactgacggcatggt

SEQ ID NO: 25603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcgacgagagtgaataccccatctggca

SEQ ID NO: 25604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcgactctgggatgataagtatagcgac

SEQ ID NO: 25605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcgagcatctgtggctggaatcgctttg

SEQ ID NO: 25606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcgataaggctcgtcgtagccatatttt

SEQ ID NO: 25607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcgcggcggtaaccatgggacgctggcg

SEQ ID NO: 25608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcgctggaacgcccaactgccttgtcct

SEQ ID NO: 25609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcggcacgcctccagctgcgagtgagca

SEQ ID NO: 25610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcggtatcatagtcctgagggggaggcg

SEQ ID NO: 25611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagctacgggatggattctttcagcggggt

SEQ ID NO: 25612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagctcagagggtgcgtgcaaaaaaggtta

SEQ ID NO: 25613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagctcgtaggtccctcgcatcgaccgcgg

SEQ ID NO: 25614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagctctgttctgcatacgtgccaccttct

SEQ ID NO: 25615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagctgagatcggagtgttgtcaagccgga

SEQ ID NO: 25616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagctgggggtgtctcccttgttggccgag

SEQ ID NO: 25617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagctgggtacgggtgtattgtaagcacgg

SEQ ID NO: 25618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcttaaggttagggatgcatctctggta

SEQ ID NO: 25619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagcttattaaccggcgtcatatacgttgc

SEQ ID NO: 25620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggaagaaccggggcaaagtcggacgctg

SEQ ID NO: 25621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggaagcgtcgtaacgtggttgcctctca

SEQ ID NO: 25622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggaatgcttaggttggtccggtggccac

SEQ ID NO: 25623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggaattgtcgtgccttggccatttaagg

SEQ ID NO: 25624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggacaacacatgatgggccgcaacgttt

SEQ ID NO: 25625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggacccataaaagttagtgagtgtcgat

SEQ ID NO: 25626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggacgattaaactgttgataagcgtcgc

SEQ ID NO: 25627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggagaataaaggtaacagtgcaagtagt

SEQ ID NO: 25628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggagatgttactggccgttagtcggtca

SEQ ID NO: 25629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggaggctctaaggcataaacgtagaggg

SEQ ID NO: 25630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggagtgggactgtattagtgccaggacg

SEQ ID NO: 25631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggatagcttatattgctccggtcacagc

SEQ ID NO: 25632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggatcaatgtcatggctcgttagggccg

SEQ ID NO: 25633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggatgtggacggagcaccacccaggagc

SEQ ID NO: 25634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggattggcggggtcggacggcggtaggg

SEQ ID NO: 25635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggcagctgcatgactccacggcattgct

SEQ ID NO: 25636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggcatcgggcatgtgttatggcagacgg

SEQ ID NO: 25637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggcgcgagcaggactgacccgctctcgt

SEQ ID NO: 25638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggcgcgctatgcaagaaggtttttggtt

SEQ ID NO: 25639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggcggtcggttatttctgggggtttgct

SEQ ID NO: 25640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggcgtacggatacagcgttaacacgagg

SEQ ID NO: 25641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggctgctggtcaaagttggtctatgcct

SEQ ID NO: 25642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagggaaactcagttgtgcacgaataccgg

SEQ ID NO: 25643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagggatataggatgcactgtgaaatggtg

SEQ ID NO: 25644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagggatatcggtggtggacaaaacactac

SEQ ID NO: 25645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagggatgcggtattctatttgtacgacgg

SEQ ID NO: 25646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagggattctgcaataactgacgtactgac

SEQ ID NO: 25647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagggcctgcgtgtttcaccacccgtacac

SEQ ID NO: 25648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagggctgtcaggcacgatgttatcccagt

SEQ ID NO: 25649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggggacgattcacttacggctgtgaatg

SEQ ID NO: 25650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggggtgcctgggtctacagccgacgtta

SEQ ID NO: 25651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagggtcaattcccctgtaaaacacgctcg

SEQ ID NO: 25652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagggtcacggtgcgtgcctggggtacttc

SEQ ID NO: 25653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagggtcgtcctgtgatggtcaggtatctc

SEQ ID NO: 25654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagggtctgctgggcggggtgttgtacggc

SEQ ID NO: 25655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagggtcttgtacgaaacgcccgtagtcga

SEQ ID NO: 25656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagggtgacgtacaactcataacttatgca

SEQ ID NO: 25657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagggttcgtacggtctctagccgggtgtc

SEQ ID NO: 25658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggtaggcttccatgtaatagctagacac

SEQ ID NO: 25659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggtattctcagcgcaccgctttgtatga

SEQ ID NO: 25660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggtccgacggctggtctcgttgcctcgc

SEQ ID NO: 25661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaaggtttcctagagttttccgaaagatacc

SEQ ID NO: 25662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagtaagccgtgtggggcgctggcgtgggt

SEQ ID NO: 25663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagtaaggctcttctgacggtgttacgcat

SEQ ID NO: 25664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagtactcgtggaataggggggattcgaag

SEQ ID NO: 25665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagtcagggtacctccgaggtgtgtggaca

SEQ ID NO: 25666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagtccagctactgtgttgacgacgcgacg

SEQ ID NO: 25667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagtccaggatacgttacttgctgtcgatc

SEQ ID NO: 25668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagtccatgcgcgtagcttgttgaagcacc

SEQ ID NO: 25669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagtgccgtgtcctacaagtggacgagcgg

SEQ ID NO: 25670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagtgcgcgacgacaccctatctggttccg

SEQ ID NO: 25671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagtgtgcgtcgggagtgccgattgcgttg

SEQ ID NO: 25672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagtgtgggcgtgttgcgatcggggccgaa

SEQ ID NO: 25673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagttcgactagtgaatggcgggaccacgt

SEQ ID NO: 25674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagttgaacgcaaagccctcgcttaacgcg

SEQ ID NO: 25675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagttgcaggcagtgtttcgctacttggcg

SEQ ID NO: 25676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagttggactctggtagaggtatcttcagg

SEQ ID NO: 25677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagtttagagcgggatgcggtggcatggtg

SEQ ID NO: 25678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagtttcttggtactctcgtagggagtaat

SEQ ID NO: 25679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaagttttgttctgccgttggtacaagtggc

SEQ ID NO: 25680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaataaatgctcgatggtcgttctgaggtaa

SEQ ID NO: 25681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaataacgattgagtaactcctggggtgtct

SEQ ID NO: 25682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaataacgcgtgggactgggtctagtggcga

SEQ ID NO: 25683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaataatctgaggggtgggcatggcattgcc

SEQ ID NO: 25684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaataattctaggggtttatccgttacttgc

SEQ ID NO: 25685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatacccctaatgaagtatacagcctggcc

SEQ ID NO: 25686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatacccgtgttttgcagatgcctgacgtt

SEQ ID NO: 25687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaataccgtctggaggctactcggctcctac

SEQ ID NO: 25688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatacctcgtgatgaagggggccaattgta

SEQ ID NO: 25689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatactcacggctgcccattttgttcctct

SEQ ID NO: 25690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatagacgcaaacctgtgtgttgtcttgtt

SEQ ID NO: 25691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatagcaggggtgatggaatctgagatgta

SEQ ID NO: 25692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaataggacgctacaccgaattgtggccgct

SEQ ID NO: 25693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaataggaggcagtcggataggaattagagg

SEQ ID NO: 25694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatatacggttgacctacctttaaagttgg

SEQ ID NO: 25695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatcactcgtttcgttatgcgaaggcaggg

SEQ ID NO: 25696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatcagcaggtcgaaccccccggccacctc

SEQ ID NO: 25697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatcagccgactagctttttacgacctccc

SEQ ID NO: 25698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatccagtccgcaaacccgttgttcgcgtc

SEQ ID NO: 25699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatcctcactccagacgggcgtggaatgtc

SEQ ID NO: 25700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatcgaaacaaggccaacggttaactcaac

SEQ ID NO: 25701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatcgaacgaggtctgtcagcgcccgtgat

SEQ ID NO: 25702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatcgatgtctccttgagtcaaactgggga

SEQ ID NO: 25703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatcgcccatctcgccgcttactcgccgta

SEQ ID NO: 25704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatcggccgtcgtccgactaagtagtgcct

SEQ ID NO: 25705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatcgggtacgctgtaaccatggttcagca

SEQ ID NO: 25706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatctagtgggacgggttgggagctagtta

SEQ ID NO: 25707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatctgaagtagtagcagacacaagaggct

SEQ ID NO: 25708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatgaatgtgtccgattgacgacttccgtt

SEQ ID NO: 25709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatgaccatggaaggatagtggggtagctc

SEQ ID NO: 25710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatgagcaaagcgatcgggaaccgttgttt

SEQ ID NO: 25711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatgcaaatgcggacggcagtcggctaaag

SEQ ID NO: 25712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatgcaagcgccacagttaaagcctctacc

SEQ ID NO: 25713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatgcacgaaggcgaccacaatatccgtca

SEQ ID NO: 25714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatgcatcaggtggagcgatgtggtgatcg

SEQ ID NO: 25715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatgcatgttctgtcgatactggcgggact

SEQ ID NO: 25716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatgcccggaaaagactcttacaaacgacc

SEQ ID NO: 25717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatgcgtgtactaaagcgttgcacatttgg

SEQ ID NO: 25718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatgcttagtatccttgaattgttgaaaca

SEQ ID NO: 25719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatggaagaccgacccctggcttttcacgt

SEQ ID NO: 25720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatggctgttttactcatgtgctcccccgt

SEQ ID NO: 25721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatgggcgtgccagtcagatagtctttgca

SEQ ID NO: 25722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatggtatagtcattgacactctttttcgg

SEQ ID NO: 25723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatggtggcgtgttactacggcatctacgg

SEQ ID NO: 25724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatgtaaaacccgccattatcacggctgtc

SEQ ID NO: 25725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatgtccttgtaggctcacaggatacgaac

SEQ ID NO: 25726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatgtggcggtatcatgtgggggaagttga

SEQ ID NO: 25727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatgtgggaccacccggttgctccttagcg

SEQ ID NO: 25728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatgtttgcagttctccgtcgtgcagatct

SEQ ID NO: 25729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatgtttttcaggcccagacataattgcgc

SEQ ID NO: 25730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaattgaaccttctccgagcctgggactaac

SEQ ID NO: 25731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaattgatatggacacttgatcctgtttcac

SEQ ID NO: 25732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaattgctttgtgcactagggtagggacccg

SEQ ID NO: 25733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatttgacttctaaggaaagcgggatcgtc

SEQ ID NO: 25734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatttgccgcccagtctggtccgttgtaca

SEQ ID NO: 25735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaatttggtaaggcggccaactgaggttcgt

SEQ ID NO: 25736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaattttccgggcaaggtcgtcgcgttcgtc

SEQ ID NO: 25737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaaaaggtccttgtgcctcacattgctgc

SEQ ID NO: 25738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaaaagtacggtgcccggaatacgggaat

SEQ ID NO: 25739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaaccatatagtggctagcaagcataagg

SEQ ID NO: 25740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaaccctcccgtatttagatcagaccgcg

SEQ ID NO: 25741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaaccttgaggcactgtcgaatcgtttga

SEQ ID NO: 25742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaacgaattggggtttagttatcacaggt

SEQ ID NO: 25743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaacggaagcgagcgtgaaggcaacgccc

SEQ ID NO: 25744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaacggtccataggttctcgaagttctag

SEQ ID NO: 25745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaacgtagaggaggcttgcaccctctttg

SEQ ID NO: 25746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaactcgcagttcccgccggcttccaata

SEQ ID NO: 25747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaactgcacagctctggcggacttgagtt

SEQ ID NO: 25748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaagggacagtggactgatcgtttcgacc

SEQ ID NO: 25749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaagggcgggggacatcacgggaagactt

SEQ ID NO: 25750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaagtaactgtctgtgtgaatcttgtcta

SEQ ID NO: 25751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaagtcacgaccaaccgagggataggctt

SEQ ID NO: 25752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaataggcgggtaaaggctaggcattaca

SEQ ID NO: 25753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaatcatgttttgaccccaccgacaaagt

SEQ ID NO: 25754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaatctcgtccaggttccattgcatggga

SEQ ID NO: 25755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaatgagaatcgagcgcgaggtgcgtggt

SEQ ID NO: 25756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaatgaggcccaacgactgagcgggcgag

SEQ ID NO: 25757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaatgattccacgacggactaacgagctc

SEQ ID NO: 25758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaatggatatcaagtggttacattttcga

SEQ ID NO: 25759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaatgtatgcctcgaccgtctgtacaggt

SEQ ID NO: 25760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaattcaaaggcgcgatttagcaacgaga

SEQ ID NO: 25761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacacaacttgagaagtagtggcagcttctg

SEQ ID NO: 25762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacacagagtaacagccatgtgcggccggcg

SEQ ID NO: 25763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacacaggtgcaacgggctactcatttgcgg

SEQ ID NO: 25764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacacattccatacagcggcctgctaatctc

SEQ ID NO: 25765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacacatttccgagacttaagcgcgttcgac

SEQ ID NO: 25766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaccaccaatataggtcagtagtgacgcg

SEQ ID NO: 25767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaccatgccgacacattctctagcagtgt

SEQ ID NO: 25768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaccctctgcggatgaaagtgctaggcgg

SEQ ID NO: 25769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacacccttacagtgccgttatggtgcaacg

SEQ ID NO: 25770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaccgcatgcagctaattcgatttggtcc

SEQ ID NO: 25771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaccggaatttgcgaaggcgagttcgtcc

SEQ ID NO: 25772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaccgtgtgctgcaacaagacgtcatgtg

SEQ ID NO: 25773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacacctttcgagtcggggagttatccgggg

SEQ ID NO: 25774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacacgaagagtcaacgcttatatattggcc

SEQ ID NO: 25775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacacgacccatcaatcgaagcgtttttttc

SEQ ID NO: 25776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacacgcgacgtgaatcaacacgcatcatcg

SEQ ID NO: 25777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacacgcgagttatgtatcctgtcactggat

SEQ ID NO: 25778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacacggacatgttggggtacgaaacatgtc

SEQ ID NO: 25779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacacggagccgaacaccgatcgtatttgcg

SEQ ID NO: 25780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacacggggttcttgggcacaacgtttctgt

SEQ ID NO: 25781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacacgtgagacgactgatcctccatgggcc

SEQ ID NO: 25782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacactaatggtttagaggtactgtcgctct

SEQ ID NO: 25783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacactacgctagctaaaggcccggggctca

SEQ ID NO: 25784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacactggtcacgcgtctccgcggtagttca

SEQ ID NO: 25785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagaaccgtggcaactcgccctacaggtt

SEQ ID NO: 25786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagaagcgcaacagagggcacgcgcctgg

SEQ ID NO: 25787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagacatgtgcggaggccgatttatgagt

SEQ ID NO: 25788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagaccggtcaagaacctatacctgcggc

SEQ ID NO: 25789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagactggggagggcgtcgcgccgaagct

SEQ ID NO: 25790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagagacaacattaccttttcctggggac

SEQ ID NO: 25791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagatctatgatgggctactttttggatc

SEQ ID NO: 25792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagcaaggggccggatattacggaacgcg

SEQ ID NO: 25793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagcaattggtagctgcgcggttgaggtg

SEQ ID NO: 25794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagccgcggtgggtagcgtttgttcagtc

SEQ ID NO: 25795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagcgaaacggctaagcctgtgccgagcg

SEQ ID NO: 25796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagcgagatcctccacgggacgtctcctc

SEQ ID NO: 25797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagcttaaaatttactcgcttacgcccca

SEQ ID NO: 25798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaggaaaaggacgaacgggcactagcatg

SEQ ID NO: 25799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaggacccatgagttggacagctcatcac

SEQ ID NO: 25800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaggaggggcaaagatgactatgtggcca

SEQ ID NO: 25801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaggcggaacagaggataagggagggcgc

SEQ ID NO: 25802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacaggtatggaacgagcatgtgtttcgaag

SEQ ID NO: 25803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagtaggattgagtctatgcgtgtacggc

SEQ ID NO: 25804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagtagtaccgagctgcacggggaactgg

SEQ ID NO: 25805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagtccggggggtactaattcggttcgtt

SEQ ID NO: 25806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagtgggtaccgactgaaagcttccggct

SEQ ID NO: 25807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagttaggatctctggtcaccaacgttgt

SEQ ID NO: 25808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacagtttgcatctctcgtatccattttgtc

SEQ ID NO: 25809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacatacaggcgctgggggtgacggcttgtc

SEQ ID NO: 25810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacatacctttttgatgcttaagctttcggc

SEQ ID NO: 25811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacatagtacagtctattctcggtaattaac

SEQ ID NO: 25812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacatcagcccagttagcaaggcggaccccg

SEQ ID NO: 25813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacatcgtcccagctgtataggctctacgcg

SEQ ID NO: 25814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacatcgtgggccagatcgtaccggctgttt

SEQ ID NO: 25815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacatctttttgccggggcacaccagttggg

SEQ ID NO: 25816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacatgagctcactagctatcttcatcctcg

SEQ ID NO: 25817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacatgcgttgacttgcctgaggagcatccg

SEQ ID NO: 25818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacatggacagggcacaacaccttccgactt

SEQ ID NO: 25819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacatggaggcactctttcgccccttctcct

SEQ ID NO: 25820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacatggatcaccgtacattggattgtcgat

SEQ ID NO: 25821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacatggctcttccacagggctgcattcccg

SEQ ID NO: 25822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacatgggcgggatccacgcagacacgcttc

SEQ ID NO: 25823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacatggttgaggaaggtcgcaacctcacca

SEQ ID NO: 25824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacatgtgctcgcaaaaaccgggtgcgtcac

SEQ ID NO: 25825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacatgttaatttaacgtggaaatcgtcttc

SEQ ID NO: 25826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacattaggaggcggacttactcctcggttg

SEQ ID NO: 25827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacattcagtgtcatccgatgggaaagggta

SEQ ID NO: 25828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacattcggtgaaatcccagtgtgacggaat

SEQ ID NO: 25829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacattctctcggtgctagaggtctcacgtt

SEQ ID NO: 25830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacattggtgtgattcggtatttccccagct

SEQ ID NO: 25831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacattgtcaagttaaatttgtagatctgcg

SEQ ID NO: 25832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccaatgcagcccgtgaagtttccgcagac

SEQ ID NO: 25833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccacacgaatttttccatctcctcttgta

SEQ ID NO: 25834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccacgaattgacccgggataagcgccaat

SEQ ID NO: 25835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccacggcaggaaaacgggtgtcgggcgct

SEQ ID NO: 25836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccagatgagccgcgttcaaacggggtctc

SEQ ID NO: 25837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccagatggggtctagtcattgagcatctc

SEQ ID NO: 25838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccagcacaggcaaccacgatccttatgtt

SEQ ID NO: 25839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccagcgatgcgtaaacttatggtaagagc

SEQ ID NO: 25840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccagcgtaaggctttatgacatagcacac

SEQ ID NO: 25841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccagctcctcacgtcttgtccgccctgtg

SEQ ID NO: 25842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccagctggttcatgatatgtgtcgggctg

SEQ ID NO: 25843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccaggtgacagggaaagattcgacggtac

SEQ ID NO: 25844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccaggttcgctttcaaagggaatcgcgga

SEQ ID NO: 25845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccaggttgaggatccggaaaaaagaggtc

SEQ ID NO: 25846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccatcgtttcttaagcaggtgtccgtggt

SEQ ID NO: 25847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccatgattcaccctcatgactacgaggct

SEQ ID NO: 25848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccattgaactgtctatgctttgtttggca

SEQ ID NO: 25849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacccaagggaaaccgtgctgcctaaggtgt

SEQ ID NO: 25850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacccacagttacctggcgttcgattgagta

SEQ ID NO: 25851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacccaccggacggcagttacggtttggctc

SEQ ID NO: 25852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacccagagtgcaggacgcggaggtttggca

SEQ ID NO: 25853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacccaggacggttccttgtagaagggtttg

SEQ ID NO: 25854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccccgcactggaactttgaaaggtctcgt

SEQ ID NO: 25855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccccggtcattgggaagaggaggattcgt

SEQ ID NO: 25856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccccgtgtaagccgcggttatggagaatc

SEQ ID NO: 25857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacccctgattgcagcgaggggtgtaggccg

SEQ ID NO: 25858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacccgaagggaagaagttccagagtgggct

SEQ ID NO: 25859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacccgaatcaggaagtgcatcctgcaacgt

SEQ ID NO: 25860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacccgatcctactcaataccggacaacatg

SEQ ID NO: 25861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacccgatgtgacaccactagatcgtgtcaa

SEQ ID NO: 25862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacccggtcctgcgacgatttgccatggccg

SEQ ID NO: 25863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccctacttcatgtgtcctagcgtttgagg

SEQ ID NO: 25864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccctattggtaagtctatgtttcatcgtg

SEQ ID NO: 25865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccctcctcgcttgctattaggaattccgc

SEQ ID NO: 25866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccctgctcgtggtcttcgtctcacgccac

SEQ ID NO: 25867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccctggattgctcccacggcgtgtacgac

SEQ ID NO: 25868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccctgttgcacgaccgtatgttcttttga

SEQ ID NO: 25869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacccttccggatatggactctctcacgctt

SEQ ID NO: 25870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccgaaccttaggttacgggttgaggggcg

SEQ ID NO: 25871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccgacacactcgagatgtacgctaacctt

SEQ ID NO: 25872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccgacacccgagtttggcttcaggccatg

SEQ ID NO: 25873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccgacgatgcgttaagttgtactcgctcg

SEQ ID NO: 25874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccgactatcgacggaaccatctagcctcc

SEQ ID NO: 25875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccgactcgggcacctgatactggtagcta

SEQ ID NO: 25876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccgagggacacgtcagactaccactcgct

SEQ ID NO: 25877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccgatagcagtaatcacgtggggagggga

SEQ ID NO: 25878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccgcatcggttccagcgagtacagatttg

SEQ ID NO: 25879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccgcgcaaggtagatttgatggaggatgg

SEQ ID NO: 25880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccgcggacctgacatcacttgcactcatt

SEQ ID NO: 25881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccgctgacggagctggtatgcgaggacac

SEQ ID NO: 25882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccggaagtaggcctgtgtcgtgagcctga

SEQ ID NO: 25883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccggacaaccttgtcgcacccgggtggtc

SEQ ID NO: 25884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccggacgcacctttgaccgccatttggta

SEQ ID NO: 25885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccggcagagtaagcacgtagacatggttt

SEQ ID NO: 25886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccggccctaaggtccatctctcgacacgt

SEQ ID NO: 25887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccggcgagatgtaaccatgcgtcatgaac

SEQ ID NO: 25888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccggcgattttgaagacgatcacgcattc

SEQ ID NO: 25889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccggctgggagattggtttgctgcagtcc

SEQ ID NO: 25890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccgggtaggaacagatggttttctcggtc

SEQ ID NO: 25891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccgtctctggcacgaagattgacgcgatc

SEQ ID NO: 25892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccgtgaggctaaaactgtggatgggggcg

SEQ ID NO: 25893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccgttaatgctcttcttgtcgtctgcccg

SEQ ID NO: 25894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccgttacagcgcgggcctcttgatgaatc

SEQ ID NO: 25895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccgttttattcgtaccagtatcataacga

SEQ ID NO: 25896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacctagcatcgtctcgtttgtgccattgcg

SEQ ID NO: 25897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacctaggatgcgccgcgtgtcattcgggtg

SEQ ID NO: 25898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacctatcactttgggggtagaagggcgtgg

SEQ ID NO: 25899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacctatgtgaacatcgggtggaggcggttt

SEQ ID NO: 25900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacctccgtggaaacaagacgcgtgcacttt

SEQ ID NO: 25901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacctcctgtttgcaaatgttagtcgatata

SEQ ID NO: 25902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacctccttcaaggttgaactaggcgcgccg

SEQ ID NO: 25903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacctcggcattctcggaccgatactggatc

SEQ ID NO: 25904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacctctcgattagctgtcacgagatcatta

SEQ ID NO: 25905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacctctgacgcgattcaattaccctcgaaa

SEQ ID NO: 25906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacctctgtgttactcacttggttaccggga

SEQ ID NO: 25907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacctgaacgttacgccggccactacgttcg

SEQ ID NO: 25908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacctgccgaagaaagtggccagattcgatc

SEQ ID NO: 25909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacctggggggacgcggccgtggaggtaggt

SEQ ID NO: 25910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacctgggggtgcttccgcggaatgaacctg

SEQ ID NO: 25911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacctgtcaatatcgttgtgacgctagcagg

SEQ ID NO: 25912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaccttccagtagtgccacaattcggggcga

SEQ ID NO: 25913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacctttcccgcctcgcactaagaaacatac

SEQ ID NO: 25914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgaaaaggtcgacgacttgcttcctgggc

SEQ ID NO: 25915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgaaactgtggactgtcgaccccgcgatc

SEQ ID NO: 25916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgaacattcgactttgattcgcgtatgtg

SEQ ID NO: 25917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgaagctgcgatacatgtgcattcatttg

SEQ ID NO: 25918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgaatcctgtaccttagcggtgacagctg

SEQ ID NO: 25919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgacaaagagccgggggccgtcttaggcg

SEQ ID NO: 25920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgacaatagcggccaggtttagctccgga

SEQ ID NO: 25921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgacaatcgcgatctacggtgcgctgctt

SEQ ID NO: 25922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgacaggccctatcccaggggtggtctcg

SEQ ID NO: 25923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgacaggtgcgtcaacattcggccaggcg

SEQ ID NO: 25924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgaccacacatccaatccgcctgtttcct

SEQ ID NO: 25925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgaccacgggttttaagcgaagtctggcc

SEQ ID NO: 25926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgacctcacggcccgactcttgttgatac

SEQ ID NO: 25927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgacgaaggtgcgggtatgcaatattgca

SEQ ID NO: 25928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgacgattggcttcggaggcagacatgcg

SEQ ID NO: 25929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgacggcagcgtgggtctgaatcggaggg

SEQ ID NO: 25930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgactccccgtttaaaccctacggcaagg

SEQ ID NO: 25931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgactctgctagtatccctccagttagac

SEQ ID NO: 25932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgagaaaattgcagtcgatatgttgccgc

SEQ ID NO: 25933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgagagaggctccacgttctgacgatctt

SEQ ID NO: 25934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgagcacttggcatcctcacgttactcga

SEQ ID NO: 25935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgagcggttgatgctcctcaattggcccg

SEQ ID NO: 25936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgagctgcagatggtgaagtcttgagccc

SEQ ID NO: 25937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgaggagggcgtccattgggcttcgatgc

SEQ ID NO: 25938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgaggatcgcgcgcgtcataacgaggccc

SEQ ID NO: 25939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgaggcagttaagtggcctggtgttggca

SEQ ID NO: 25940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgaggtaaggatctcgcgactgtggtacc

SEQ ID NO: 25941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgagtcgggagtattagcgtagttaagtt

SEQ ID NO: 25942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgagttatgtcttttagtcctttcaccgc

SEQ ID NO: 25943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgagttgacccaccttagcggacctgggt

SEQ ID NO: 25944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgagtttcccttgaggtggcggttgctta

SEQ ID NO: 25945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgatacccagtccgattgggcggttttgc

SEQ ID NO: 25946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgatacggtacgagctggtcgaactccgt

SEQ ID NO: 25947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgatactcgttaaagcggtggcccaagct

SEQ ID NO: 25948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgatagaccatagccgcgtcatacaccct

SEQ ID NO: 25949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgatatacgagagcgcccgctgcacgcca

SEQ ID NO: 25950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgatcaaggcatacggaacacctgcgatt

SEQ ID NO: 25951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgatcccggcacgcatcgagttgtggagg

SEQ ID NO: 25952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgatctgcattaatttcatttgtgctcta

SEQ ID NO: 25953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgcaaagagcaactccgacagtgggcagg

SEQ ID NO: 25954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgcaacaccggcatccaaaggcggaacgt

SEQ ID NO: 25955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgcaagcggtatcaaaggagccttagtcg

SEQ ID NO: 25956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgcacatggcccaatgatcagccgcctgc

SEQ ID NO: 25957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgcagacagatgtgataaaacctggctac

SEQ ID NO: 25958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgcagcgccgggccagcgctaacggtctg

SEQ ID NO: 25959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgcaggactaccgatttcgggcgcgcagg

SEQ ID NO: 25960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgccattaacagcttgacactccccgccc

SEQ ID NO: 25961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgcccgtggcatagcgctgtatttttcga

SEQ ID NO: 25962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgccctaagtggtcttactgttactatgg

SEQ ID NO: 25963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgcgcaggagccatcacttaggtgcagat

SEQ ID NO: 25964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgcggaccacttagacgcagcgggctccg

SEQ ID NO: 25965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgcggccgatgcaagtagcccaagccccg

SEQ ID NO: 25966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgcggcttctctacgccgagtttaaggtt

SEQ ID NO: 25967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgcgtacgtgcgctctgcaccgttcggcg

SEQ ID NO: 25968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgcgtctggatacttttcgtacgacagtg

SEQ ID NO: 25969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgcgtcttgtctcagcctcaggtgttgcg

SEQ ID NO: 25970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgcgttcttgtctgcagctgatgctcccg

SEQ ID NO: 25971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgctaactcggcaatcgatactacgcgcg

SEQ ID NO: 25972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgctagctaaggggaggtattgctaagcg

SEQ ID NO: 25973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgctattcacacctgaggcgttaaccctc

SEQ ID NO: 25974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgctccctatgaccacttcacaccctgct

SEQ ID NO: 25975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgctggatagacaggataacagcgcgata

SEQ ID NO: 25976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgctgtcccttcgcgtgaagcccgccctc

SEQ ID NO: 25977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggaacaagtgcgcctggcgtcgagtgtc

SEQ ID NO: 25978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggaacactgtcggacgcgtgcggaaagt

SEQ ID NO: 25979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggaacctccctgagtgcatttggacttc

SEQ ID NO: 25980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggacagacgcaatcttctgcgaggacat

SEQ ID NO: 25981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggacatccgatgttcttattcgtgtatg

SEQ ID NO: 25982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggaggaagggcgggctcttggaaccaat

SEQ ID NO: 25983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggaggttagttgacccacaatttcggac

SEQ ID NO: 25984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggataacgctgacatgtgatttggcggg

SEQ ID NO: 25985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggatcgcgtgccaatgcgcctcttgcac

SEQ ID NO: 25986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggcaatgagctaaatcaccgtggcaatc

SEQ ID NO: 25987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggcagtctacttttgcgtaccgggcagc

SEQ ID NO: 25988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggcctggttctttgggtattcgtcgcat

SEQ ID NO: 25989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggcgcgtttgtttgcctcatctctgtcg

SEQ ID NO: 25990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggcggaagtcagagaggatcatgtagtt

SEQ ID NO: 25991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggcgtcccggtgcgtgtcgttagggccc

SEQ ID NO: 25992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggctagtacttggttgcgctccatcttt

SEQ ID NO: 25993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggctgtctctcgtaccggggcttatcat

SEQ ID NO: 25994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggctttaaccagcgaacatggcttacgt

SEQ ID NO: 25995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgggaaggcgcggcgaggtacccgggctc

SEQ ID NO: 25996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgggaccggggcagccacgggtgattcga

SEQ ID NO: 25997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgggactgttagcgcgcggcttgactcac

SEQ ID NO: 25998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgggaggccctgcgttgacatctcgggtg

SEQ ID NO: 25999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgggagttgcaggctatgcgttacctggc

SEQ ID NO: 26000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgggcactggggcacggcttagctccgtg

SEQ ID NO: 26001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgggtattatacgctcggattcatcgtcc

SEQ ID NO: 26002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgggttttctaagggagaggggcacgtct

SEQ ID NO: 26003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggtaaagagtgctgaatcgatttgggca

SEQ ID NO: 26004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggtatctagctgtccttactttatatat

SEQ ID NO: 26005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggtcaccgtaacatcaagtacgacgaat

SEQ ID NO: 26006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggtccgaagagcgctcgctacaactttt

SEQ ID NO: 26007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggtcggcagaggcagacgaatcgcttct

SEQ ID NO: 26008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggtgcggaccagtcatcacacagtggcg

SEQ ID NO: 26009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggtggaaccacgattttagggcacttgc

SEQ ID NO: 26010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggtggactggaagacgttcgcttccctc

SEQ ID NO: 26011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggttaaagcgtcaaccaacggggagtcg

SEQ ID NO: 26012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacggttacaatggatcatatgctctcttat

SEQ ID NO: 26013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgtaaattgggctattatgggagggttgt

SEQ ID NO: 26014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgtacacggcaaaacgctgatggcgcgcg

SEQ ID NO: 26015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgtaccgaccacgtaggtcgagtcatgtg

SEQ ID NO: 26016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgtacggggaaatctccagtcctctcgta

SEQ ID NO: 26017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgtagcggctaattggtcaccagggtccg

SEQ ID NO: 26018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgtatcgattagtgtcaatctctctggtc

SEQ ID NO: 26019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgtatcgggcaggacgaacgatacgtatc

SEQ ID NO: 26020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgtatgcgtatttgcacagtgtagtcctg

SEQ ID NO: 26021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgtattgtaggtcactgtgcggtgcgttt

SEQ ID NO: 26022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgtcagggcacgaggtgtcgcgtactcca

SEQ ID NO: 26023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgtcctcgaatacatgttgccttgcgagc

SEQ ID NO: 26024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgtcgccagtctgtctaccaaacgcagtg

SEQ ID NO: 26025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgtcgcgtccctcggttatttgtggattg

SEQ ID NO: 26026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgtcggccgagcacgttttgtttcgccaa

SEQ ID NO: 26027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgtgaacctactgctaccccgctgcggtt

SEQ ID NO: 26028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgtgatcggaggggcggcagacaatatgt

SEQ ID NO: 26029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgttacttttcgagtttgttcggcacatt

SEQ ID NO: 26030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgttcacagagcttggacacctcggggtc

SEQ ID NO: 26031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgttccgacattttgattctgtcccgctc

SEQ ID NO: 26032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgttgcttaatagatcgtggcttttgcgc

SEQ ID NO: 26033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgttgttcgggggaggattgcgtcggggg

SEQ ID NO: 26034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacgtttaaggttgcgcaaggcgtggtatgt

SEQ ID NO: 26035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactaaagcgaggggatcagtcatcagtaca

SEQ ID NO: 26036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactaacgcttgaccattccaacagtagatt

SEQ ID NO: 26037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactaagcggagtgacacaaggttagggtgc

SEQ ID NO: 26038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactaataatgcctgctaagacttgttgtta

SEQ ID NO: 26039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactaatgtcagcgcgtcgtgtcccgtttca

SEQ ID NO: 26040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactaattggtacgggaccagcgcacgaacg

SEQ ID NO: 26041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactacagaacccggtgattgactctgacgg

SEQ ID NO: 26042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactacctcagcgacgcgacgatcacatcct

SEQ ID NO: 26043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactacgaagtcgggagatcgtcatctgcgt

SEQ ID NO: 26044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactacgatcgcttggtcatttagggtatcg

SEQ ID NO: 26045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactacgcgatgagtggtgcgccacagctcg

SEQ ID NO: 26046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactacggacggaggggggaggccgacctgc

SEQ ID NO: 26047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactactagccatccaacacgagcggcagtg

SEQ ID NO: 26048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactactctgcgttaaagcgtactcggtcga

SEQ ID NO: 26049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactagctatcccgaattggaggggggttcg

SEQ ID NO: 26050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactataatgcgcgggttttcttagctttgc

SEQ ID NO: 26051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactatctggctcacattgattgcggcctaa

SEQ ID NO: 26052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactattgcatagtgtctcgatcagctgagg

SEQ ID NO: 26053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactcacctgggcgtgtggatatagttacgt

SEQ ID NO: 26054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactcactcacggttatgagatgtatgggcg

SEQ ID NO: 26055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactcatatcaatactctagtctgtgccaac

SEQ ID NO: 26056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactcatgatgtctgatgggaggattaggtc

SEQ ID NO: 26057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactcatgtagggctgctcggcgagcgatca

SEQ ID NO: 26058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactcatgttagacggcgtgtaaccacttat

SEQ ID NO: 26059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactcattactcaggggctcgaacaggcttc

SEQ ID NO: 26060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactcattagactcagcattgcaaggagtcc

SEQ ID NO: 26061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactccaattcacgggaagcgtcgcatcaat

SEQ ID NO: 26062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactccaccacacactcgagttacacgcctg

SEQ ID NO: 26063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactccacggatgacgtatgtgcaatgccgt

SEQ ID NO: 26064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactccagcccgttcgaaaagcgcggtgcct

SEQ ID NO: 26065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactccagctgagagcgcgcttctgagctag

SEQ ID NO: 26066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactccataccttactgatattggacggcgg

SEQ ID NO: 26067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactccctgatgtggtgcacttgggagtgta

SEQ ID NO: 26068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactccttgacgactgagtataattggtcgc

SEQ ID NO: 26069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactcgaaatctggcgcagtcctttgcatgg

SEQ ID NO: 26070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactcgaacgtgggaaccgcgtactttggta

SEQ ID NO: 26071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactcgacacatgcgttcaagcgggcatccg

SEQ ID NO: 26072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactcgattgcgtatacgaccctgccacgcg

SEQ ID NO: 26073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactcgggagaggccggttcacgtttgtagg

SEQ ID NO: 26074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactcgttatgtagcgtatgatgaaaactgg

SEQ ID NO: 26075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactcgttcggaatatacttacccaagccat

SEQ ID NO: 26076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactctcagtgtgcagaacgtgtctggagcc

SEQ ID NO: 26077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactctctttgcgaatgtaggtattgggcac

SEQ ID NO: 26078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactcttctgaagctcgatagctgggcaacg

SEQ ID NO: 26079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgaacaatgccgttcggatagcaccgcg

SEQ ID NO: 26080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgaatgacgatatgcgcattatcggagg

SEQ ID NO: 26081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgacacggtaagcaatccctctgcgctg

SEQ ID NO: 26082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgacactgaaaatcgtggctgtccgcga

SEQ ID NO: 26083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgactatgggctgccgttctcaggttcc

SEQ ID NO: 26084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgactccgtaattggtccagatggtgcg

SEQ ID NO: 26085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgagctccctgttcgtgaagtttagacg

SEQ ID NO: 26086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgatattcgtcaacagcacccctttgaa

SEQ ID NO: 26087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgatcctcttgcgtctgcctggggagag

SEQ ID NO: 26088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgcactggcatttactctctcatcccgc

SEQ ID NO: 26089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgcagtatatggcttagacacggtggcc

SEQ ID NO: 26090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgcctgcatggtcgataggcttgtagcc

SEQ ID NO: 26091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgctacgccattacgcttacaccccgtg

SEQ ID NO: 26092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgctgcattcacctagatgagtgtcggg

SEQ ID NO: 26093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactggacgtgtcgggcccatccctctgtcc

SEQ ID NO: 26094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactggaggcacaggccgtcatggtttacac

SEQ ID NO: 26095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactggccagatacgcaaccgcaaagctcgc

SEQ ID NO: 26096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgggcttttctctctcggctctctgtag

SEQ ID NO: 26097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgggtagcacgtacgggccgcgcaggta

SEQ ID NO: 26098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgggtgcagggagcggggtctcgctcgg

SEQ ID NO: 26099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactggtgggcgctttcattgtattctgggg

SEQ ID NO: 26100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactggttgtgatgtgcgttgctttcctgtg

SEQ ID NO: 26101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgtagatatgctgaccccaggctacagt

SEQ ID NO: 26102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgtcaatgcttatattcgaaattcacgc

SEQ ID NO: 26103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgtcatcgaagtgtgctgggaagacatc

SEQ ID NO: 26104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgtcgaactagcctccttccagtattac

SEQ ID NO: 26105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactgtctcgtagggtcgctgctttcacctg

SEQ ID NO: 26106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacttacgagcagacccccgatgttatgtgc

SEQ ID NO: 26107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacttagcaccgacgtcttggccatttcgga

SEQ ID NO: 26108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacttaggtggtagggggcgcgactgtacgt

SEQ ID NO: 26109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacttcgaacccgggtgtccttgcaatgctg

SEQ ID NO: 26110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacttctgcgctctcactcgtataatggtac

SEQ ID NO: 26111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacttgacttccacaggctacaatatgccgg

SEQ ID NO: 26112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacttgagttggttactcttctgcatcggac

SEQ ID NO: 26113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacttgcaattccaaggttgcggatgctatt

SEQ ID NO: 26114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacttgcctctgtaccaccctgcgtctcgtc

SEQ ID NO: 26115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacttggcgttaaggttagcgctagcacgtt

SEQ ID NO: 26116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactttcaccttctgagatcttggtgtgcac

SEQ ID NO: 26117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactttcggccgagaggtccccgcctgcacc

SEQ ID NO: 26118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactttgaatgccggcgatgcagtccctggc

SEQ ID NO: 26119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgactttggtcaatctctgtcctgtgctcgcc

SEQ ID NO: 26120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgacttttttttatttcatacccctcttaatt

SEQ ID NO: 26121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaaaacgtaccgcgctccgagtcttttat

SEQ ID NO: 26122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaaaagcgcagcccaccatgctcgcagtg

SEQ ID NO: 26123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaaaaggcactaacgggaatcctcgtcac

SEQ ID NO: 26124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaaaatgcaagccagcacgggacgaaggc

SEQ ID NO: 26125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaaacaactcggtgcgagctggtaatgcc

SEQ ID NO: 26126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaaagtccgaataagtagactcaggttga

SEQ ID NO: 26127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaaccactagcgtccaagtcgagtcgtcg

SEQ ID NO: 26128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaacccgggccgtacgatcgtttgtctga

SEQ ID NO: 26129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaacgaggggcccaatgcgcgattacgcg

SEQ ID NO: 26130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaacgctggagcacggggtcgttgacaaa

SEQ ID NO: 26131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaacggattgaattctttggggactttcg

SEQ ID NO: 26132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaagaaacgtgtattcatcatgcgtgcgc

SEQ ID NO: 26133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaagcacgataacctaaacgtgtgaatgg

SEQ ID NO: 26134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaagggtttacggcaaccacatcggtcat

SEQ ID NO: 26135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaatatgagtgactaacttgattacggtt

SEQ ID NO: 26136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaatcgaatgataaccgtgggcctgcaaa

SEQ ID NO: 26137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaattgaacgaaaaagaccaatggccggg

SEQ ID NO: 26138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaattgttcgtatagaaagtgagagtggt

SEQ ID NO: 26139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagacaacttggtgaaaagcctctctcgatc

SEQ ID NO: 26140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagacaattgctgggccgtggtgcgctccgg

SEQ ID NO: 26141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagacacctcaggggacggggtacgatctgc

SEQ ID NO: 26142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagacactgggcccgcttttgttgtttaccg

SEQ ID NO: 26143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaccgaaaaggattccttgagcttgtgct

SEQ ID NO: 26144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaccgacgggatgcgaaatccgcacgtct

SEQ ID NO: 26145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaccggggcaaacggacttaccatctctc

SEQ ID NO: 26146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaccgtaatataatttaaggcgtacaccg

SEQ ID NO: 26147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagacctgacgtttaacaataccagctaggc

SEQ ID NO: 26148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagacgacccgtccacaagaacttttccacc

SEQ ID NO: 26149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagacgagaggcgggctcctccttgtgttgc

SEQ ID NO: 26150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagacggctaacatattactgggtctgcgac

SEQ ID NO: 26151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagacggttatttttcacttttctggagtgt

SEQ ID NO: 26152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagactattgggacgttaggggctgcagcga

SEQ ID NO: 26153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagactccggcagtgtagtgggcaaatagtt

SEQ ID NO: 26154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagactggcggcgttgtgttagtctttggcc

SEQ ID NO: 26155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagactgtcagaacctctaaatcgttatgga

SEQ ID NO: 26156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagagaattgcacctgattggatctgctcgg

SEQ ID NO: 26157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagagacgcctgtctgaggatctaagtgttt

SEQ ID NO: 26158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagagagagaatgcattctattcgattgcga

SEQ ID NO: 26159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagagagtgcgatatggcaagttacatgtcg

SEQ ID NO: 26160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagagcaagtactatctctcgggccggtttc

SEQ ID NO: 26161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagagcggttgccctgtgactgggtgttcaa

SEQ ID NO: 26162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaggaaaggacgtgactttggtgccacga

SEQ ID NO: 26163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaggcggtccgtcgagcgctgtcccgggc

SEQ ID NO: 26164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaggctagcggtcaacgattatgtggtcg

SEQ ID NO: 26165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagagggcaacgtgtagttgacggttgcgtg

SEQ ID NO: 26166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagagggcgcatttgataatcatatgacttg

SEQ ID NO: 26167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaggggatgtgtgtgcgctgacccacgaa

SEQ ID NO: 26168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagagggtaaaacaaacttcagcgataccgc

SEQ ID NO: 26169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaggtcacatacggtcgtgactttggtgc

SEQ ID NO: 26170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaggtgacgcgacgtgggttgtggagtgc

SEQ ID NO: 26171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaggttcgccgagtagagactcagtcatt

SEQ ID NO: 26172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaggttgttccttggggtacggggcccac

SEQ ID NO: 26173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagaggtttccaagtcagtccttcttcggac

SEQ ID NO: 26174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagagtacggcctctttagatcacgatagag

SEQ ID NO: 26175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagagtaggcctgagcgccagtccgtcctga

SEQ ID NO: 26176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagataaggaaggagacgggcgagctacagg

SEQ ID NO: 26177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagatcagaggaacgtgccttaagcgagtgc

SEQ ID NO: 26178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagatcctatctcttgtattctgcgtcgagg

SEQ ID NO: 26179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagatcgctcccgtgctgaaaacctgattcg

SEQ ID NO: 26180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagatcgtgacaaccttcggcttcaatgcgg

SEQ ID NO: 26181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagatctaagggttggcgtgaatcataatta

SEQ ID NO: 26182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagatctagtatcgcatatgagactcacggc

SEQ ID NO: 26183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagatgacggtgtagccagggtggtcccgtg

SEQ ID NO: 26184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagatggcgcataggaatggggaatggtgtt

SEQ ID NO: 26185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagatggggacgcccgagctactatatccct

SEQ ID NO: 26186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagatgtcgaaacacgttctgctgtcatggt

SEQ ID NO: 26187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagattattgtttccgtgtatggtttggggt

SEQ ID NO: 26188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcaacaacctgtggaggttgacgtgttcg

SEQ ID NO: 26189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcaacatatccactcgagcccatatgttg

SEQ ID NO: 26190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcaacgcgctaaacccgttgtggagccgc

SEQ ID NO: 26191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcaagcaatcccatcatagtacttcatct

SEQ ID NO: 26192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcaatcattcggtcggtcactgtagtcac

SEQ ID NO: 26193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcaatcctatgtatcacactcttccgcac

SEQ ID NO: 26194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcacaagggcgaatgcgcggagccgtgag

SEQ ID NO: 26195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcaccctggtgtttcgattgcgataaggg

SEQ ID NO: 26196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcacctgttcacttgatcaacaggccctg

SEQ ID NO: 26197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcacgtccctgttatgacacgtttcagcc

SEQ ID NO: 26198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcagattagtgtgaccgacattgcccgcc

SEQ ID NO: 26199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcagccaggtggttaaacatgtagggtcg

SEQ ID NO: 26200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcagcggacaatgtcgacggtataccgag

SEQ ID NO: 26201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcagggtaatcgtccgcatctggttgctg

SEQ ID NO: 26202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcagttccatggcgcttagagagcatggt

SEQ ID NO: 26203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcataaggcttggagtcgcgggaccgctc

SEQ ID NO: 26204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcatagattgatggcatgcgaccgcaatc

SEQ ID NO: 26205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcatgtcgagcggcgcagcggcgggggct

SEQ ID NO: 26206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagccaacgaagagcgtggaccctcttttgc

SEQ ID NO: 26207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagccagcaaatccaaccgtcgctttctgcc

SEQ ID NO: 26208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagccaggcaggtgctgagggacagtgcgtg

SEQ ID NO: 26209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagccagtcaatggcgtaaccagcctgttgc

SEQ ID NO: 26210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagccattagacctcactgtgcacatggcaa

SEQ ID NO: 26211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcccaacgtaagaactcggtgtagcgggg

SEQ ID NO: 26212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcccgacccttagctgtttgaactatcgc

SEQ ID NO: 26213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcccggaaaaggcggggtttacatcttcc

SEQ ID NO: 26214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcccgggatgcaattgcgttccactctcg

SEQ ID NO: 26215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagccctatgaatgtcactttggcggccgaa

SEQ ID NO: 26216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagccctgttaatagtacacctgtgacttat

SEQ ID NO: 26217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagccggacggtcgtgccgttaacctttttc

SEQ ID NO: 26218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagccggcacactttgcctgttttgtctgga

SEQ ID NO: 26219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagccggggggcgctcaccggttcattaggc

SEQ ID NO: 26220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagccggtaacttgcaggatgcgatggtctg

SEQ ID NO: 26221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcctaacttgtctcgttttctaggcgtat

SEQ ID NO: 26222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcctaccgcagggtgatcgatgcaagttc

SEQ ID NO: 26223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcctactttgacccttggttgccacagca

SEQ ID NO: 26224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcctgtaacgtatgcagactatgcactcc

SEQ ID NO: 26225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgaccaggatggattgcccgtcgtactg

SEQ ID NO: 26226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgacgtattagtatgagcagtcttcttc

SEQ ID NO: 26227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgagcgatggggcctatttggcaatttg

SEQ ID NO: 26228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgaggctggtaaccgggattcgtgtcgc

SEQ ID NO: 26229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgatgaaagcagagatcggtggtctggt

SEQ ID NO: 26230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgatgagtccgaagcgagtcggccccgg

SEQ ID NO: 26231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgcaacccgtaaggaccatggaggatag

SEQ ID NO: 26232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgcaaggtgtggacgtcgggaaagacac

SEQ ID NO: 26233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgcattttacaccagcgcgagaagcccc

SEQ ID NO: 26234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgcgactccgatactgctagctatgccg

SEQ ID NO: 26235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgcgataacgcaagtcgttctttgtgct

SEQ ID NO: 26236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgcgatactttctgctcggttggcggag

SEQ ID NO: 26237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgctactttttagctctaacgggaaggc

SEQ ID NO: 26238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgctcgtccagcgtgtggttcggcatga

SEQ ID NO: 26239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcggcaggtgcgatctctggccatgcctt

SEQ ID NO: 26240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcggcatggcgggactagcatacttggaa

SEQ ID NO: 26241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcggcctggcgctagaaaatgcaatggcg

SEQ ID NO: 26242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcggcggtgttgtattcctcggggtcgcc

SEQ ID NO: 26243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcggcgtcttaacctttgtcgtccgccgt

SEQ ID NO: 26244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgggcgtcctgcagtctaactgattggg

SEQ ID NO: 26245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcggggggcgtctgctaccaccttacttg

SEQ ID NO: 26246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcggggtggcactaacatgatctctctct

SEQ ID NO: 26247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcggtacgggtccctgcgaaatgatagcg

SEQ ID NO: 26248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgtaatccggagctctggtggggtgccg

SEQ ID NO: 26249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgtaggttttcgagatccgctggtcatc

SEQ ID NO: 26250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgtcagtatgccttggtcacttgtgtta

SEQ ID NO: 26251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgtcccactgagaattctttatcgattg

SEQ ID NO: 26252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgtcccccgttacagatgggatgtagga

SEQ ID NO: 26253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgtcggataccatcctggactctgcttg

SEQ ID NO: 26254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgtcgttgggcctgggtgcttaaggaga

SEQ ID NO: 26255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgtgatgcgttgtagttgaccgtgtcgg

SEQ ID NO: 26256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgtgcattgtggtgcgcatcagggccgt

SEQ ID NO: 26257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcgtgggaacgagccgcaagccacagtga

SEQ ID NO: 26258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagctaccttggatcgaagtcgcacttggcg

SEQ ID NO: 26259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagctactttgttagtcaccatttcgtggaa

SEQ ID NO: 26260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagctagcggacgtgggacccatacatccaa

SEQ ID NO: 26261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagctatatcttagctcttgatgcttttgtc

SEQ ID NO: 26262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagctccaggaccttttgttttcaggactcc

SEQ ID NO: 26263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagctcgcggtgactgtccttgatatacccc

SEQ ID NO: 26264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagctcggggcttatctcaacgggacacatc

SEQ ID NO: 26265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagctcggtagggacggataattgaaatggt

SEQ ID NO: 26266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagctgccggacagtgtgggtgcgttgggtg

SEQ ID NO: 26267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagctgcgagagctactgttccgacgcatta

SEQ ID NO: 26268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcttaaacaggaatcgtgatgcaagcagg

SEQ ID NO: 26269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagcttcgacgtaactcgtgcgcatgcggga

SEQ ID NO: 26270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagctttcgtcagccgtgaccgggcctcgta

SEQ ID NO: 26271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagctttgattgtgcaatgccccacattagc

SEQ ID NO: 26272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggaaaaatcaagtgcctatcgccaggttc

SEQ ID NO: 26273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggaaagggctaattgatcggcggttggaa

SEQ ID NO: 26274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggaaagttgggagtgggcgatgaattaat

SEQ ID NO: 26275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggaagcgatccgcggcggcgctagggggg

SEQ ID NO: 26276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggaatcagtcagggcgtagttaatcccga

SEQ ID NO: 26277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggaatcgacggcacaatacgttctgggca

SEQ ID NO: 26278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggaatgagattgatagtcggaaacgtata

SEQ ID NO: 26279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggaatgttttccggcgcggaaatgtgtgc

SEQ ID NO: 26280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggacacactgactcattgtaggccgtggg

SEQ ID NO: 26281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggacacagagacgtatgcaattctgtgcc

SEQ ID NO: 26282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggacacgttgcaggaggcgtcatggggct

SEQ ID NO: 26283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggaccgacgcgaactccccccgtctcgtc

SEQ ID NO: 26284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggacggacatcagcaacccaaggcgatgg

SEQ ID NO: 26285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggacgttgcgggcatcaagccatgagcgt

SEQ ID NO: 26286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggagaccctgcgttaaggctataatcgag

SEQ ID NO: 26287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggagaggtggcccagcgaaaccagatcta

SEQ ID NO: 26288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggagcagatgatggctccactgggtgatt

SEQ ID NO: 26289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggatcatggtcctatcaatcccacctgtg

SEQ ID NO: 26290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcacgagtggttgcaggtacagacgccg

SEQ ID NO: 26291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcactagtcaagttgtagctacacgggc

SEQ ID NO: 26292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcagcgtcacttggaggtcacaagtacg

SEQ ID NO: 26293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcagctacaatagtgcaatatttcgagg

SEQ ID NO: 26294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcaggcgacggaacaaccttatgcgcac

SEQ ID NO: 26295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcagtccgagcgtgggggctctatccaa

SEQ ID NO: 26296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcatgattgacgtccagttactaccctc

SEQ ID NO: 26297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggccaaccgtcatacctgtggcacttcga

SEQ ID NO: 26298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcccgaattcttttactaggttcttcgg

SEQ ID NO: 26299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggccggccctgcatgcagacagacgcgag

SEQ ID NO: 26300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcgaatggctaccagcaactgtgctacg

SEQ ID NO: 26301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcgagtcgatagcctgtaacgtggcatt

SEQ ID NO: 26302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcgccctgagggaggattacatgtcagt

SEQ ID NO: 26303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcgcgatcggagtatctatgcgcggagg

SEQ ID NO: 26304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcgcggtcaggggtggtggtaccagatg

SEQ ID NO: 26305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcgctgacgttctccttaagctgacgag

SEQ ID NO: 26306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcggcgtgcgttaccgcgcactactagc

SEQ ID NO: 26307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcgggtacggatttcctgccgatcgcgc

SEQ ID NO: 26308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcgggttattgaggtcttgcggactgat

SEQ ID NO: 26309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcgtaaaggctcatataatcgcctaact

SEQ ID NO: 26310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggctccgacacggacaagcgtagggtcgc

SEQ ID NO: 26311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggctccgtcttcatgcaaggttacactac

SEQ ID NO: 26312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggctgcatctgctgtttggggtgactcac

SEQ ID NO: 26313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggctgggaacgtgcacgctgtgactcctc

SEQ ID NO: 26314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggcttgggatgatatgtttcatttgtggg

SEQ ID NO: 26315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggaaaccctgggcgcactcaccatgact

SEQ ID NO: 26316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggaagattgtgttgagcgtccgcgctag

SEQ ID NO: 26317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggaagttgacggcgataggatgctacct

SEQ ID NO: 26318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggaatctgacttgttgcgtagcgaggat

SEQ ID NO: 26319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggacccatcgtgtattatagaagcagtt

SEQ ID NO: 26320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggaccgaaccaagctgtagtgctcaggc

SEQ ID NO: 26321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggactcacgtgccatcacctgcctacgc

SEQ ID NO: 26322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggacttccaaggtgtgcctttccagtcc

SEQ ID NO: 26323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggagaatggtcgcgatcatacagcaatg

SEQ ID NO: 26324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggcaagaccggaacccggcatgcgaggt

SEQ ID NO: 26325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggcaatccgggtgagactcgtcgaagag

SEQ ID NO: 26326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggcacgtctggggcttgacttggcttct

SEQ ID NO: 26327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggcagacacggctgacagtcttgtttgt

SEQ ID NO: 26328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggcagattatatgggctggagttgcttt

SEQ ID NO: 26329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggcaggagtttgacaaaacgttaacggt

SEQ ID NO: 26330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggcaggggcttagggttttttgtccatc

SEQ ID NO: 26331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggcagtgggtggaattggtctggggata

SEQ ID NO: 26332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggcatcaaacgcggtgaggatattcata

SEQ ID NO: 26333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggcccataccggtaagtcttagcgcgca

SEQ ID NO: 26334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggcctaaaatgttccatggtatccgatg

SEQ ID NO: 26335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggcgcgtcgtgcgttctgatcacagcgg

SEQ ID NO: 26336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggcgtcgaggcaagctggacgtggctgt

SEQ ID NO: 26337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggctatgccggtcaattgggccacaagt

SEQ ID NO: 26338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggctccttcgtctgcacggtaacatagt

SEQ ID NO: 26339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggctgacgttaagacaagtaagtgtggt

SEQ ID NO: 26340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggctgggttggcgagtgtgaagcgccgg

SEQ ID NO: 26341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggctggtgttagcttagcacatgcgggt

SEQ ID NO: 26342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggggaacgcttcgtcgtggctaatgcaca

SEQ ID NO: 26343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggggactgattggaccggtgcggcgcgtt

SEQ ID NO: 26344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggggattggtggtttcgggctgagttgtc

SEQ ID NO: 26345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggggcatccatttccccacggagcagcaa

SEQ ID NO: 26346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggggccgcagcttacgaattatataatga

SEQ ID NO: 26347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggggcgagaccacatttcttgggttatca

SEQ ID NO: 26348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggggctaactgctgctcactcttgtcgga

SEQ ID NO: 26349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggggctcggagtaagtcccgtcgggttac

SEQ ID NO: 26350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggggcaaacttcgagttcattatgagcg

SEQ ID NO: 26351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggggcagctcgggcacgtttttagacct

SEQ ID NO: 26352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggggccgtttcgaggtcacgtttgggtg

SEQ ID NO: 26353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggggtgattcatcttgcctgggagaggt

SEQ ID NO: 26354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggggtgaggcggccgtttcgcccatcaac

SEQ ID NO: 26355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggggtggtagaatgtcccgtcacatctaa

SEQ ID NO: 26356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggggtttattatgcggtgctgcttggctt

SEQ ID NO: 26357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggtaagctggtagacgaactacacatag

SEQ ID NO: 26358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggtgccggtgtttggggacaagcggata

SEQ ID NO: 26359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggtgcgctgcttacagtcctcttcgggg

SEQ ID NO: 26360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagggttagcaggcacccattgaggcaaaac

SEQ ID NO: 26361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtaaagcatgtgttatggtgctactggc

SEQ ID NO: 26362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtaagtaggtttgtctgttagattcgga

SEQ ID NO: 26363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtaccgaaaaggcgtcagggtgtatggg

SEQ ID NO: 26364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtacgagaggggacccaggtgagatcta

SEQ ID NO: 26365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtacgcagcgcgttggtgaagaacgcta

SEQ ID NO: 26366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtacgccgtgtagcgactaatggggcgg

SEQ ID NO: 26367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtacgtcggcgccctccatcgttaccta

SEQ ID NO: 26368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtagtatgtatatcgtacgtatcgcggc

SEQ ID NO: 26369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtagtctgatgtggaccgaattgaacat

SEQ ID NO: 26370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtagttagccatcgcgtgtacactaacg

SEQ ID NO: 26371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtatagtctgcctacgtttattgccttt

SEQ ID NO: 26372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtatttcattcgttaaatgaggggttca

SEQ ID NO: 26373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtcaacgcatgaagacgggagcgcatgg

SEQ ID NO: 26374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtcaggcatgcagctgtaatattgggca

SEQ ID NO: 26375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtccctgacttgggccgacttcaggaat

SEQ ID NO: 26376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtcgaggatggggaccggtctgtacacc

SEQ ID NO: 26377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtcggcagtccgggaagtcgaagcagac

SEQ ID NO: 26378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtcgggcgtaaaacgaggacaagggcgc

SEQ ID NO: 26379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtgactacgctgataggggatctttaga

SEQ ID NO: 26380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtgactcttcactcaccagtaactgtgg

SEQ ID NO: 26381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtgagcgacacaaccagatacagcgctc

SEQ ID NO: 26382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtggcgtccatacgccgcaatggcactg

SEQ ID NO: 26383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtgggagggaggtgcgagtgtgttcgtg

SEQ ID NO: 26384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtgtactttccgacctccatgattaagt

SEQ ID NO: 26385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtgtcagtcagatgcttcgtgtgttggt

SEQ ID NO: 26386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtgtcatagtgcggtcgctctgcgcgct

SEQ ID NO: 26387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtgttcagttgttctatgctaggaccaa

SEQ ID NO: 26388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggttaatgaaatgatttcgtgtgctttgg

SEQ ID NO: 26389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggttatgctagcagggacaacgtgtattc

SEQ ID NO: 26390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggttgcttaggtaatgtttcagggctgtc

SEQ ID NO: 26391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggttggcaagtgcggtcggtgatgcatcg

SEQ ID NO: 26392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtttgttctgatgtggatgcttttgctg

SEQ ID NO: 26393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggttttgctatacgtaaagacatgattga

SEQ ID NO: 26394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgaggtttttgcatggcacagagttggaatcg

SEQ ID NO: 26395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtaagtacttaggcgagagttgtgactac

SEQ ID NO: 26396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtaccggcgttcggttcggtatcagctcg

SEQ ID NO: 26397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtaccgggcgcactaaccgctgtatgcga

SEQ ID NO: 26398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtacctggtgttatcctcctgctctcttc

SEQ ID NO: 26399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtacgcacgatcgcggggtgcgcgactgg

SEQ ID NO: 26400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtaggattcgcgtagttccgtgctgtgta

SEQ ID NO: 26401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtagtcgatctcgtgtaattgcgctcgta

SEQ ID NO: 26402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtagtgttttatctgggttccctagcgtg

SEQ ID NO: 26403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtatctaatccctggaccaggggtttctg

SEQ ID NO: 26404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtcaatttcggttgggccttgttggtcat

SEQ ID NO: 26405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtctatcgattcttcttggtgttggtcga

SEQ ID NO: 26406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtctttttgcgatcagtaactgcgggccg

SEQ ID NO: 26407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgaaacgccgaaacctcgtgctatcgcg

SEQ ID NO: 26408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgaaggttgaagtttttgcccgactgcg

SEQ ID NO: 26409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgagcgcttgaatgctcgttctgccggt

SEQ ID NO: 26410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgagggcgctgaagataggcgtggtgga

SEQ ID NO: 26411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgagtagcacaccattgagcgtacgttg

SEQ ID NO: 26412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgagtcaccgcttcagtgtgccaaggcg

SEQ ID NO: 26413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgattttgggctacttggtgtcagtgtc

SEQ ID NO: 26414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgcaactggatatgttttaaatacagcc

SEQ ID NO: 26415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgcaatcacgatgatggcatttggtggg

SEQ ID NO: 26416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgcacataggctgttgttgggtgtttac

SEQ ID NO: 26417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgccacgcatagaaaatatcttgttttt

SEQ ID NO: 26418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgccggtcggacagtgcagagtcgaagg

SEQ ID NO: 26419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgcgagcaggttggagagagatcgttta

SEQ ID NO: 26420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgcggttccaattaggctactgtgaccg

SEQ ID NO: 26421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgctcacggccatctgccgccctgccta

SEQ ID NO: 26422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtggagcggcctcaatgatgtactgcgga

SEQ ID NO: 26423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtggagtaagtgaccaaggctccgggcgg

SEQ ID NO: 26424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtggcccagcgtcttggcttggtttgcta

SEQ ID NO: 26425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgggaatcgggactaccgcgtttatcga

SEQ ID NO: 26426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgggatagggagttcgcggggcgcgtgt

SEQ ID NO: 26427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtggtagtctattctttccattgcggctt

SEQ ID NO: 26428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtggtgcgggggagagtccgtttgttcga

SEQ ID NO: 26429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgtatcgaaagtaataccgtggacaatg

SEQ ID NO: 26430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgtctacataaatctagctcatcctttc

SEQ ID NO: 26431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgtctatttgttgctctggactatgcct

SEQ ID NO: 26432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgtctgaatccttcggggagggccaatc

SEQ ID NO: 26433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgtgctgggggctggaacgcggggggtc

SEQ ID NO: 26434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgttgctccgagacactttgttttttgt

SEQ ID NO: 26435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtgttgtccctaagtcgttaatgttgaag

SEQ ID NO: 26436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagttagcagggcatttttcactagctgggg

SEQ ID NO: 26437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagttagctgccaagcaaatatctaatcagg

SEQ ID NO: 26438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagttagggcaacatggcgcctgaactcacg

SEQ ID NO: 26439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagttcggacgtatgatactggttggtacgc

SEQ ID NO: 26440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagttcgttttctcctctcgtgccatgtcgt

SEQ ID NO: 26441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagttgaactgggactaattgaggtcagcaa

SEQ ID NO: 26442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagttgcccggtcgtaggcaggattacatgc

SEQ ID NO: 26443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagttgccgcgtggcttggacgcctggcgaa

SEQ ID NO: 26444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagttgtcggctatataaggacgaagcgcgg

SEQ ID NO: 26445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtttctatgacaggtcccttcatgccgtc

SEQ ID NO: 26446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgagtttggctgctgtgtcgtcacgcggggcc

SEQ ID NO: 26447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataaaaccaccgaccgttgtgcgcagtgcc

SEQ ID NO: 26448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataaacggttctctcttagtgccaagttcc

SEQ ID NO: 26449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataaacgtcagtggtaaccgccctggcccg

SEQ ID NO: 26450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataaattatgtttaaccggagattctcggt

SEQ ID NO: 26451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataacaacgtcgtgtattaccgaggtggaa

SEQ ID NO: 26452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataacatggcatacattcgctaggattaag

SEQ ID NO: 26453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataaccgtgcttgggcagcgtcggtcggtg

SEQ ID NO: 26454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataacctccacttctgaacgcagtcccatc

SEQ ID NO: 26455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataacctcgccatgatgcgctcgggtgtcc

SEQ ID NO: 26456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataaccttggtcaagtggtggctggggtgg

SEQ ID NO: 26457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataacgattgatagtggggtgctgccggtc

SEQ ID NO: 26458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataactggcctcaactggtaccgctcgggc

SEQ ID NO: 26459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataacttctgcatatcatgtttgggtagta

SEQ ID NO: 26460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataagtaggctcacacaagttcgatgccgt

SEQ ID NO: 26461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataagtccaaatagggttgctcctcctact

SEQ ID NO: 26462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataagtgtcgacggctgtgtggtggatcaa

SEQ ID NO: 26463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataagttttgggttcttgagacgtgtgact

SEQ ID NO: 26464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataatctgcagccaacgatcattgcaatca

SEQ ID NO: 26465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatacaacgttgaggtcttgttggggcggaa

SEQ ID NO: 26466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatacacacagagctcttcgccatgtcaacg

SEQ ID NO: 26467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatacagctaactgccagcgcctactaaaag

SEQ ID NO: 26468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatacaggcgtcatgtcgcgcggtgtgttac

SEQ ID NO: 26469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataccacattgtcttaccgcgtccacttgg

SEQ ID NO: 26470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataccaggttttattaaggctagtatgccc

SEQ ID NO: 26471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataccagtctgtcaccaccggtacacatgc

SEQ ID NO: 26472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataccccatgggactatctcaccacaggct

SEQ ID NO: 26473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatacccccagcgttgggcctccctgcatgc

SEQ ID NO: 26474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataccgaattgtgttaactgcgcacatggc

SEQ ID NO: 26475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatacctttattcaattgcttagggggtaag

SEQ ID NO: 26476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatacgagcaactttaccgcgcgatcacgtg

SEQ ID NO: 26477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatacgattttccgtgggccaaagttaaacg

SEQ ID NO: 26478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatacggcaagaataaggatctgtagacttt

SEQ ID NO: 26479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatacggcacgaagattattccagtttgcgc

SEQ ID NO: 26480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatacgttcccgccccggtcttgttagagtg

SEQ ID NO: 26481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatactaggccacggccctttgccgcggggt

SEQ ID NO: 26482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatactccagtcgatgaccgcgagacacata

SEQ ID NO: 26483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatactccattggtatgagtgttgcccccca

SEQ ID NO: 26484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatactcctcagctagactgtctaacgggcc

SEQ ID NO: 26485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatactgaggattcctaacgacttgggagat

SEQ ID NO: 26486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatactgttacggtggttacctttctgtcga

SEQ ID NO: 26487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatacttgcttaacttcttcgtgcttccaga

SEQ ID NO: 26488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatacttgttaagttttggtaccacgatatc

SEQ ID NO: 26489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatactttaacctaaatctcgttatcgtcat

SEQ ID NO: 26490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatagagattatcgtcggaggggtgacaggc

SEQ ID NO: 26491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatagagtaattgctggtgcccagagtccgg

SEQ ID NO: 26492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatagatggtaatggagcaacaagtgggtgg

SEQ ID NO: 26493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatagcacgcaccaaggtctgaaatccctcg

SEQ ID NO: 26494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatagcacgcttttaagcaactcatcctatt

SEQ ID NO: 26495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatagcacgtgttaggaccaaaacgggcgtg

SEQ ID NO: 26496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatagcagtcagtacgagcctcctctggtta

SEQ ID NO: 26497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatagccagcagcaacctcttttctgctttt

SEQ ID NO: 26498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatagccggctcggacgattgaggataccgt

SEQ ID NO: 26499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatagcgcacggtaggctagcggtatccaag

SEQ ID NO: 26500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatagcggattaagttatttgcaaatgggcg

SEQ ID NO: 26501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatagcggtgttagcgttgtactcggggtgg

SEQ ID NO: 26502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataggagacctcgtctttccgtatatttcg

SEQ ID NO: 26503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataggctcactgattcctggcactctcgct

SEQ ID NO: 26504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatagggaacattcgtaaacacttgacgagg

SEQ ID NO: 26505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatagggcagaaaccaaacgcgagcggcact

SEQ ID NO: 26506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatagggccctggattgcaactgaggtagac

SEQ ID NO: 26507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataggtaaagatggactacggtctttatcc

SEQ ID NO: 26508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataggtgtcccgagttctcgattattagtc

SEQ ID NO: 26509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgataggttgggttttcctgcacgggctgcgg

SEQ ID NO: 26510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatagtactgctctgaggggacctaatggac

SEQ ID NO: 26511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatagtgtttaccaatctcctgccatagaaa

SEQ ID NO: 26512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatagttgctcgcgtttaaatatctccctcc

SEQ ID NO: 26513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatatagtttgagacacgacacgggatcatc

SEQ ID NO: 26514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatatatcaaggtaagcttcttgtcgcctcg

SEQ ID NO: 26515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatatcaatccacttcttactgtgcgtgcgg

SEQ ID NO: 26516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatatcggtaccatccgggcagttctgtcct

SEQ ID NO: 26517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatatgacgcgctgaactcagtctcataagg

SEQ ID NO: 26518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatatgcccttgcaaataaccaataaaggcc

SEQ ID NO: 26519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatatgcgaaaatgtgattgttctacactag

SEQ ID NO: 26520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatatgcgtgcagtactacaaccaataggcg

SEQ ID NO: 26521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatatgggagttagtcacctccccagggtac

SEQ ID NO: 26522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatatgtccaatttgtctattgcggatcctt

SEQ ID NO: 26523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatattactccgcgatcattcggaacagtcg

SEQ ID NO: 26524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatattcgtttggacagtcgatcgcaactaa

SEQ ID NO: 26525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatattgagtagacgggcgcgctacttcagc

SEQ ID NO: 26526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatattgggcatctgcgtctcggcgtgcggc

SEQ ID NO: 26527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcaaacagattgccaaacgcctggccggt

SEQ ID NO: 26528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcaaataggccaatgcgcggggggtcaac

SEQ ID NO: 26529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcaacggcatcgagcggtactaagcgccg

SEQ ID NO: 26530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcaagaattcggaaatctccttttctacc

SEQ ID NO: 26531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcaagagaggacatcatgaggtctttcca

SEQ ID NO: 26532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcaagatttatgatggcactgggcatact

SEQ ID NO: 26533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcaaggatgctgccatttgaatgtcgttg

SEQ ID NO: 26534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcaataccccaatctgtcgtagcaggcgt

SEQ ID NO: 26535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcacatgagtgggtggtggcctcgtacct

SEQ ID NO: 26536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcaccgattggacgatcgttgaagtgtgg

SEQ ID NO: 26537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcaccgcaggccgtgtttgttacggaaca

SEQ ID NO: 26538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcacctgcaccttaacacggccatcgtgg

SEQ ID NO: 26539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcacgagcatgcagttacgctaattgggg

SEQ ID NO: 26540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcacgcggttggggcgcttctacattggg

SEQ ID NO: 26541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcacgctcgcggacaagcactcgtgagca

SEQ ID NO: 26542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcacggcttcaagtcgtacgtgctcctcg

SEQ ID NO: 26543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcacgtacggagaatcgtgggcaatgact

SEQ ID NO: 26544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcactcgacacagtcttgtagacctccat

SEQ ID NO: 26545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcactcggttgtgcttctccgttcgctag

SEQ ID NO: 26546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcagacctgcctctttagctatcgtgggc

SEQ ID NO: 26547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcagatgacctggcggtcaatggctcgca

SEQ ID NO: 26548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcagctgcccgacacccctgcttgatgcc

SEQ ID NO: 26549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcagtgtgattgcgcgggattacagactg

SEQ ID NO: 26550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcataacctttcgtgtctccaatcagcgc

SEQ ID NO: 26551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcatcgcgaaactttctcacggggggtgg

SEQ ID NO: 26552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcattaacatgaggtgcagggtacgcgcg

SEQ ID NO: 26553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcattgaacttagttcgaacgcactaccg

SEQ ID NO: 26554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatccaccacagtttgttcgtgctcttgcaa

SEQ ID NO: 26555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatccactttcgaccgtacgacccattgttt

SEQ ID NO: 26556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatccattacatgttgccccacatggcagcc

SEQ ID NO: 26557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcccacgactgtgacttatttcgctatgc

SEQ ID NO: 26558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcccccccaggcgcgctcaccaaagggcg

SEQ ID NO: 26559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcccgagtcctctcaatcgagggtaatgt

SEQ ID NO: 26560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcccgatcacgcgctgaggtagctgatgt

SEQ ID NO: 26561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcccggcacaataaattccatggatcccg

SEQ ID NO: 26562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatccctcgtaatacgccctagtacacgaac

SEQ ID NO: 26563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcccttccccctccagagccacccgtcct

SEQ ID NO: 26564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcccttgatggttgcactcccgtccgagg

SEQ ID NO: 26565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatccgagagcgttttcctgagctagtcggt

SEQ ID NO: 26566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatccgagttgggcgcacaaggattgcgatg

SEQ ID NO: 26567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatccgcgacgtatgcatatcttatgcttta

SEQ ID NO: 26568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatccggatactcgagttcggcaaattgtgc

SEQ ID NO: 26569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatccgtgcagtctctggacgctttgtgccg

SEQ ID NO: 26570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcctgcttggtacgttgtggactctattg

SEQ ID NO: 26571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcctggtatattgctcgtgaccagtaagg

SEQ ID NO: 26572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgaagcacaccgggcatcccctgcagca

SEQ ID NO: 26573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgaattgtcggttacgcatgtttgtaga

SEQ ID NO: 26574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgacacgcagcgtgttgacacacatcat

SEQ ID NO: 26575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgacactactttcccgatgctcattgtc

SEQ ID NO: 26576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgacagcggggagctgaggagatggtgg

SEQ ID NO: 26577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgacagcttatctcccgcaatagtctcg

SEQ ID NO: 26578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgacgttttcgggacggaaagatgtgcc

SEQ ID NO: 26579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgagactgcctctggcttggttgggtga

SEQ ID NO: 26580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgagcggcgaacaagatgtcgggtctgg

SEQ ID NO: 26581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgaggggacttttgaatctgtctgctcg

SEQ ID NO: 26582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgagtactgtacatgctcttacggtttg

SEQ ID NO: 26583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgagtttctattactttgagtaagtgtt

SEQ ID NO: 26584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgatccacggacccggaatgatggtgcg

SEQ ID NO: 26585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgatgggaggaggagttactaggtccat

SEQ ID NO: 26586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgcaacttgaagggtggttctaacgacc

SEQ ID NO: 26587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgcacgttgctaggggtcacacggccgt

SEQ ID NO: 26588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgcgagcgggcaatcacgtattcatggt

SEQ ID NO: 26589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcggcatatgggctggggtgggaccgctg

SEQ ID NO: 26590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcggcttttcgacttgcttggctttgggc

SEQ ID NO: 26591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgggccgggtctcttaaactgagcttcc

SEQ ID NO: 26592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcggggacactggggacggcgaattggca

SEQ ID NO: 26593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcggtaatgtccctgactgcatattcatt

SEQ ID NO: 26594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcggttagcagcttaaggttacgggtgag

SEQ ID NO: 26595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgtcatggctgcaatgaccttttagata

SEQ ID NO: 26596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgtcccaatccacatgtgcgcaggttgc

SEQ ID NO: 26597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgtccgggacgctatggtcatagtcgtc

SEQ ID NO: 26598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgtgactcgcagcgacactccgtgatga

SEQ ID NO: 26599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgtgcaggtacgtgctgacacgcaaggc

SEQ ID NO: 26600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgtgccttccggactccgttccttaggg

SEQ ID NO: 26601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgttaacactgatacctcctgtgtattg

SEQ ID NO: 26602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcgtttgtggtattgcacaccgcggaacg

SEQ ID NO: 26603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatctaacgcccttcgtaacggtcttggttg

SEQ ID NO: 26604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatctacatccacgtaggtgctccacgaatc

SEQ ID NO: 26605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatctaccgcacgtggtggtgtctgcacacg

SEQ ID NO: 26606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatctacgagctcatactggtatttcacccg

SEQ ID NO: 26607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatctatacgaaacgggtacccccacgtacc

SEQ ID NO: 26608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatctatatggcttccacctggtgaaccagc

SEQ ID NO: 26609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatctcctgacggttggtggaatattgttag

SEQ ID NO: 26610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatctgaccacccagactttagcttgtgaag

SEQ ID NO: 26611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatctgtttcttgcgttctctgtccaggatg

SEQ ID NO: 26612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatcttcacctggtaaggttactccgacttt

SEQ ID NO: 26613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgaacaggattttaacggccatgtgttgg

SEQ ID NO: 26614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgaacattggagcgagacgcccccaagtg

SEQ ID NO: 26615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgaacgcggtcctaagaggctgggtggct

SEQ ID NO: 26616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgaagaggaccactggacattggtctgtg

SEQ ID NO: 26617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgaaggagaacccggatgctgtgtcaacg

SEQ ID NO: 26618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgaaggagctgcaaaaagctctgcgttgc

SEQ ID NO: 26619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgaagttcagttgaggaatggatacaatt

SEQ ID NO: 26620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgaatagacgttatctcttctaggtcacg

SEQ ID NO: 26621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgacaactttatgaccctcggtttagcgc

SEQ ID NO: 26622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgacattacgggagagatgggtttcttag

SEQ ID NO: 26623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgaccactgtgtttgaggggtaataagcg

SEQ ID NO: 26624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgaccctacctgatgctgtcagataaggt

SEQ ID NO: 26625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgaccttagttttccactaactgattcga

SEQ ID NO: 26626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgacgtagttgcgcgaccgttcctctacc

SEQ ID NO: 26627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgagaagtgggtctaacgatatgtatgtc

SEQ ID NO: 26628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgagacgctgcagagtcctgtcggtctgt

SEQ ID NO: 26629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgagatgggttacttcacgattgggtgtt

SEQ ID NO: 26630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgagcaagatcggtttgttgagttttgta

SEQ ID NO: 26631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgagcagacaagtcgatcagcggccaatg

SEQ ID NO: 26632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgagcctgactggcaactaagcttttgat

SEQ ID NO: 26633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgagggctcacggtgggggtccagagcca

SEQ ID NO: 26634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgagggctcagctggattcgttcacggga

SEQ ID NO: 26635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgataagaatgcccttattttaatccgtc

SEQ ID NO: 26636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgataccaagcttggtcagtgcaacatcg

SEQ ID NO: 26637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgatgcctgtgatcaggtgcccttcccgg

SEQ ID NO: 26638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgattttggcggtgctcgagaatttgctg

SEQ ID NO: 26639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgcaatgcaattctaaggacggtgaggtg

SEQ ID NO: 26640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgcaattggcatgtcagcggtttaacttc

SEQ ID NO: 26641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgcagaagtgggcctctagggctttatga

SEQ ID NO: 26642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgcagacgtagtgaattgcaacctctttc

SEQ ID NO: 26643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgcaggcccggttacagcgagcgttatcg

SEQ ID NO: 26644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgcataccactcactttagcggacccacc

SEQ ID NO: 26645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgcatcgaatccccgagtcggttgtgcgg

SEQ ID NO: 26646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgcatggccaaaagccgatatgaccagct

SEQ ID NO: 26647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgcatttggaggcctgttgcacgctgagt

SEQ ID NO: 26648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgccccagctctgaccactgcgactaacc

SEQ ID NO: 26649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgcccccttgtctcttcacagcaagcacg

SEQ ID NO: 26650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgccgaacaggacacgttccgccctcctc

SEQ ID NO: 26651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgccggcgcacatgtccgtatcatccgtt

SEQ ID NO: 26652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgcgaacgaactcgagaacttgcggagca

SEQ ID NO: 26653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgcgaagtgcatgatctagcatttctggc

SEQ ID NO: 26654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgcgaggggttgctgcaaatctcttcctc

SEQ ID NO: 26655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgcgatattatcccgttcacgtgcctaga

SEQ ID NO: 26656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgcgcagagatcaaatataggcgacaccg

SEQ ID NO: 26657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgcgcgtagtgcgcggatgtaggactgca

SEQ ID NO: 26658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgcgtcccggcttctgtgcgcgaggtgaa

SEQ ID NO: 26659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgctaactgggcgcggcggcttgcatctt

SEQ ID NO: 26660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgctaaggtcgaccgcggaggctagaccg

SEQ ID NO: 26661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgctacggggcaatagcactaaatgatga

SEQ ID NO: 26662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgctagtgactttcgagctcgtttagtta

SEQ ID NO: 26663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgctccgagctcgcttccttgctcaccta

SEQ ID NO: 26664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgctctgcggtttgcgacaacgggttcga

SEQ ID NO: 26665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgctgaagggtcgatatgtagattgatga

SEQ ID NO: 26666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgctgaccagtggtgttttagaatactgg

SEQ ID NO: 26667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggaagggccgaggacttataccatgatg

SEQ ID NO: 26668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggaaggggcgtgtccatgtgaacgtgac

SEQ ID NO: 26669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggaagtagagccatttctcttgtgggga

SEQ ID NO: 26670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggacatggcgtgagctcttgtatgacgt

SEQ ID NO: 26671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggacgtgtccatttggcgcccgccgttc

SEQ ID NO: 26672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggaggacataatcgagcgtatgcgtgag

SEQ ID NO: 26673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggaggctcagtcttggagagcgggcgtc

SEQ ID NO: 26674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggatgaacgtttcggtattctgggggct

SEQ ID NO: 26675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggattagggaatgtcgggtgtgctcacc

SEQ ID NO: 26676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggcagcgctccaaagtcgttgatcacgc

SEQ ID NO: 26677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggcatgggcttacccccgggcgagtgcg

SEQ ID NO: 26678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggcctgttagcccttcacggcagccggt

SEQ ID NO: 26679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggcggctacggagaagcagtggaaccct

SEQ ID NO: 26680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggcggctggagaacgagaagaccgacgt

SEQ ID NO: 26681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggcgggagcgagcttttacaccctcttc

SEQ ID NO: 26682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggcggtgatggtcttgactcgacatgga

SEQ ID NO: 26683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggcgtgcattacctgtagggtggcggcc

SEQ ID NO: 26684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggcgttaagtccccaagggtccaagatg

SEQ ID NO: 26685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggctcataggtgcctgtatagcaagctg

SEQ ID NO: 26686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggctgcaatactttggtgcgtttgaccg

SEQ ID NO: 26687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggctgcgggtgctactgttggaattacg

SEQ ID NO: 26688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggcttcaagagccgcgacttcatgagcg

SEQ ID NO: 26689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggctttcttcactacatttgtcggaccg

SEQ ID NO: 26690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgggccggctctaaggcttcgctcttggt

SEQ ID NO: 26691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgggcggttgatgctgctgtatgtccgtt

SEQ ID NO: 26692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggggaatcaaacggtgaatgggcccgaa

SEQ ID NO: 26693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggggactagcctaatgggtttcccgcac

SEQ ID NO: 26694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggggatggaggacgacttcgctcaggat

SEQ ID NO: 26695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgggtacagtgaagccgttataagggcga

SEQ ID NO: 26696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgggtcccgtcttggattggaagtattgt

SEQ ID NO: 26697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggtcaaaacatcgtcttcctgtccttgt

SEQ ID NO: 26698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggtccacgctggtagacgtctggatggc

SEQ ID NO: 26699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggtcgcaagccgaatcgtcctgctggcg

SEQ ID NO: 26700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggtctcttttatggagtgcgcaacatgg

SEQ ID NO: 26701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggtctttgtgggggtttcggtgctgtct

SEQ ID NO: 26702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggtgcgccggccatttttgagctcgatg

SEQ ID NO: 26703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggtgctcaagaactcgtgagtaggtaca

SEQ ID NO: 26704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggtgctgctgtagtagttggtcatgtcg

SEQ ID NO: 26705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggtgtacggggactagccggtgcgttgt

SEQ ID NO: 26706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggttagtaggagcacgaacacctgctgt

SEQ ID NO: 26707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggttatacacaaactacagtgcgtgggt

SEQ ID NO: 26708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatggttctctgctggtacagtgtatcatgc

SEQ ID NO: 26709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtaaggtagggccttggaagttctcggg

SEQ ID NO: 26710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtacaaagaaaactgaccctcgcgcagg

SEQ ID NO: 26711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtacacttagctcatcggttatccagtg

SEQ ID NO: 26712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtcacgtgaaaacatgattgcggtcgtc

SEQ ID NO: 26713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtccgttcttctggtgctttggctccac

SEQ ID NO: 26714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtcgtggaaccgatgccggtcaaaatcc

SEQ ID NO: 26715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtgacaggaagtaccctcgtcaatccct

SEQ ID NO: 26716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtgaccgagcatgccagtgctccccggt

SEQ ID NO: 26717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtgactgacgcaatagctgggctcacga

SEQ ID NO: 26718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtgagcagacgatatcaactcgctggac

SEQ ID NO: 26719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtgattcgtgtcggctctttatgtggcg

SEQ ID NO: 26720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtgcaaggcctagtcgtacgagtgcgga

SEQ ID NO: 26721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtgccatttctggtacgcaactttctgt

SEQ ID NO: 26722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtgcggttggtcgtcaagggtagccaca

SEQ ID NO: 26723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtgggcgggaaaactgaattgcacaggc

SEQ ID NO: 26724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtggggtacttattaaatctacgtacga

SEQ ID NO: 26725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtggtggacgttcttgggtgtggcatgt

SEQ ID NO: 26726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtgtacaaagcactcaggaattaggtag

SEQ ID NO: 26727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtgtggggctcaggcgaacttcccgtcg

SEQ ID NO: 26728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgttaagcttttccgcgaaacatgatggg

SEQ ID NO: 26729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgttcagcatgctccgtagtgccatgacc

SEQ ID NO: 26730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgttgaggctgtcgccccctaccgagcaa

SEQ ID NO: 26731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgttggacccggccagggcacacctactt

SEQ ID NO: 26732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgttgggtctacgatggggctccggctgg

SEQ ID NO: 26733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtttcctgcaatatcctttgtgtactgg

SEQ ID NO: 26734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgtttggttcatacggatccaatgtgcca

SEQ ID NO: 26735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatgttttttccgggagcacggaccgttatc

SEQ ID NO: 26736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattaaaatacaagtgcccccgggtcgcact

SEQ ID NO: 26737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattaatattgcccctatcacgatgccacgg

SEQ ID NO: 26738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattaattctcgggcgatgacatgttttcgt

SEQ ID NO: 26739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattacagtcgccgtgcttagcgatttgcgg

SEQ ID NO: 26740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattacccgtcttagcttcctcgccgccctg

SEQ ID NO: 26741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattacgatctatggcctgtgctattcagga

SEQ ID NO: 26742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattacgcggagagtgttctcgcgcgcctcc

SEQ ID NO: 26743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattacgggccgaccggacttagcattatgg

SEQ ID NO: 26744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattacgtcggtcaggaggtgttagaggggc

SEQ ID NO: 26745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattagagcatattgccccaacacttacgaa

SEQ ID NO: 26746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattagcattctagccacctcagaccagcga

SEQ ID NO: 26747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattagccgtgtcgcaatcgtaatgacgctc

SEQ ID NO: 26748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattaggatcatgattctctccatatcgacc

SEQ ID NO: 26749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattatcgatcccgcataagatcagccgatt

SEQ ID NO: 26750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattatcgtcagaccgagtgctctcacggag

SEQ ID NO: 26751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattcaatgggcacgcaagcgggtccgggtg

SEQ ID NO: 26752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattcacattgggctgagcgatcagtgcggg

SEQ ID NO: 26753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattcacgcttcaagtggccaatcaaccgct

SEQ ID NO: 26754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattcacttttgttaactgggtacaggatgc

SEQ ID NO: 26755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattcagacctcggcgatactcccgtggatt

SEQ ID NO: 26756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattcaggcagcgccggcaggaagacacgtc

SEQ ID NO: 26757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattcattatcatgggctagggtcatttaag

SEQ ID NO: 26758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattcattattgttaatcacacttctttttc

SEQ ID NO: 26759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattccaccggaccatagggtatgtggggtt

SEQ ID NO: 26760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattccgcagactacccgacttcggcccaca

SEQ ID NO: 26761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattccgcctccgttttaaagccttcgcgtg

SEQ ID NO: 26762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattccgctgggtgtcagtccacagtgaggt

SEQ ID NO: 26763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattcttaattaagagggttggcttaacgat

SEQ ID NO: 26764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattgaccgatggggtgagagcgatagggcg

SEQ ID NO: 26765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattgatgtttttctttagcactgatggttt

SEQ ID NO: 26766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattgccatggtgtaattccggaatagatct

SEQ ID NO: 26767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattgccggcaacacgctagctttcacacaa

SEQ ID NO: 26768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattgccgtcggctgtcgtggtccgcggggt

SEQ ID NO: 26769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattgcgcttggcctcggcctttgaggggat

SEQ ID NO: 26770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattgcgttgaacaggactactttgtcgtat

SEQ ID NO: 26771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattgcttgaggaagatcattgggaatcagc

SEQ ID NO: 26772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattggacacggtaaatgttgtgcgccgcgt

SEQ ID NO: 26773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattggcgatcggtcggcacaagggctagct

SEQ ID NO: 26774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattggtcaagcaagcggttcgaccgttcct

SEQ ID NO: 26775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattggtcaggagtttctggcaagtgttgca

SEQ ID NO: 26776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattggtgcgacgcgttatcaggcatttagc

SEQ ID NO: 26777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattgtcagcagacgcgtatcggcagacgac

SEQ ID NO: 26778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattgtcgaatggcatggattcgggtcccta

SEQ ID NO: 26779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattgtgtagttcaaattggttaataccttg

SEQ ID NO: 26780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattgttgacaatgaatctcctcagtcttct

SEQ ID NO: 26781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattgtttcctaggcttgtagtccggcatgc

SEQ ID NO: 26782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatttaatcttgaatttctcggttaggcggt

SEQ ID NO: 26783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatttagcatacagcaattctttagcgggcc

SEQ ID NO: 26784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatttcagatccgctgattggtccgcccgtc

SEQ ID NO: 26785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatttccaacggcggattgtccgtaacccgg

SEQ ID NO: 26786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatttccgagcgtacaagcagtggccgacga

SEQ ID NO: 26787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatttcgatgacgtcttgatcttagggctgc

SEQ ID NO: 26788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatttcgtgtatagttccaagaggtactttg

SEQ ID NO: 26789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatttggaaatcgttattgacattacaatgt

SEQ ID NO: 26790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatttggcatggatgtcctattatgcgttga

SEQ ID NO: 26791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatttgttgttagtgccgcgtgtggacggtg

SEQ ID NO: 26792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgattttccgatacctcttgcagactcaataa

SEQ ID NO: 26793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgatttttgccagtctgacttttggtggcggt

SEQ ID NO: 26794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaaacgggtcggttatgcattttctgggc

SEQ ID NO: 26795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaaattttacgatttgatgcccttacgtt

SEQ ID NO: 26796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaacaagcccgtagcaaatacgattgggg

SEQ ID NO: 26797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaacaagggacgcgaaggtgcgtgaactg

SEQ ID NO: 26798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaacactgtctttccgtaagatcgccttg

SEQ ID NO: 26799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaacagcacgcgtcccggatgatgctttt

SEQ ID NO: 26800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaaccagagcccatcaggcgattaccgcg

SEQ ID NO: 26801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaacgccagttgtaaccacggtcggacgc

SEQ ID NO: 26802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaacgggttaagcgtctctccccagggtc

SEQ ID NO: 26803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaactgatcaccacgagtacacgactgcg

SEQ ID NO: 26804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaacttaatttccgggcgttggtgcaaca

SEQ ID NO: 26805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaagagggaagtggacatgatatttccat

SEQ ID NO: 26806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaagcaccgtgcaagtagtcgttcggatg

SEQ ID NO: 26807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaagggcaatggcgcagggaagggcaatg

SEQ ID NO: 26808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaagggggcatgacaatgaagaccgtgtg

SEQ ID NO: 26809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaagtgttggactatttaaggcattcatc

SEQ ID NO: 26810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaagttgggcatcagcgttccaagactta

SEQ ID NO: 26811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaatagcttgatggtttcttattctacga

SEQ ID NO: 26812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaatccctatcatagaatgaccactcccg

SEQ ID NO: 26813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaatcgatggaggtcggcccgtctgctta

SEQ ID NO: 26814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaatgccaactcttgagcttgaggcacca

SEQ ID NO: 26815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaatgccctggcctgtgacgcagacgtgt

SEQ ID NO: 26816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaatggcccacggtggatgggaaagacgc

SEQ ID NO: 26817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaacaacacagtgcggatcttggcatctct

SEQ ID NO: 26818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaacaccacaatggcctcatggcgatgtga

SEQ ID NO: 26819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaacacgacgcaacgggcgaacctgaatca

SEQ ID NO: 26820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaacaggttggctagtagctcaatgtggat

SEQ ID NO: 26821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaccacgtggtccgcagcgtgactggacg

SEQ ID NO: 26822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaccgaggccagggcgcgctctgggaatg

SEQ ID NO: 26823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaacgaacggcacgaccatgatccgggagc

SEQ ID NO: 26824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaacgaccagttcatgctcctgaatccccg

SEQ ID NO: 26825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaacgatcgtgacgatagtgaagggcctgt

SEQ ID NO: 26826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaacgatgatccagcaggtatggtacccgc

SEQ ID NO: 26827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaacgccaccctggtacgcctattcgcgtg

SEQ ID NO: 26828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaacgcgtaggcaccagtcacactccggtc

SEQ ID NO: 26829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaacgctggttcactggtcgcgccccgcta

SEQ ID NO: 26830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaacggatatatcttggcgctcacaacctt

SEQ ID NO: 26831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaacggggagcatcggggttgaatggacgc

SEQ ID NO: 26832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaacggggctaacgcgttaatttacgtgct

SEQ ID NO: 26833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaacggttgacttaggctgtaggtcaaggg

SEQ ID NO: 26834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaacgtagctgagcgggccgccagaacacc

SEQ ID NO: 26835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaacgtttaggttggtggacggcaggtatc

SEQ ID NO: 26836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaactagggtacgaaaatgtgttgaatatg

SEQ ID NO: 26837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaactagtcgtgagcagttgcaatccgccg

SEQ ID NO: 26838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaactgggagggcgctaatgggcaagccgg

SEQ ID NO: 26839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaactgtcgctgtaagttaggcctgctgac

SEQ ID NO: 26840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaactgttctcatcggcagctacgtagacc

SEQ ID NO: 26841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaactttttctgcctctgggtttggtacgc

SEQ ID NO: 26842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagaagaacggctcgtgctgaccatcgag

SEQ ID NO: 26843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagaatggaccaactgattcggggcggag

SEQ ID NO: 26844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagacacacaggggcggaatgcgctggtt

SEQ ID NO: 26845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagacggacggcatcttagtccgctcctg

SEQ ID NO: 26846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagactcgcgattaagcgtatagtccagg

SEQ ID NO: 26847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagagacgaggtgtggggaatctgctctg

SEQ ID NO: 26848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagatgagcggcgttgggtcattgggtgt

SEQ ID NO: 26849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagcaaaaaggaatgcctccccgtgatcc

SEQ ID NO: 26850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagcaaggcaagcagacatgaagtccgcg

SEQ ID NO: 26851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagcaagtcttaggacttaaatatgggtc

SEQ ID NO: 26852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagcacattgcaaacgtctgtcgaccctt

SEQ ID NO: 26853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagcggttcggtaggtgagctaatcccgc

SEQ ID NO: 26854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagctcctcaagcgcgttagatatgtatc

SEQ ID NO: 26855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagctttttcctgcctgattgacgtcgtt

SEQ ID NO: 26856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaggagtcgagagtagtggccgagggttg

SEQ ID NO: 26857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagggtatgacggtgaccacaccttaggc

SEQ ID NO: 26858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaggtaaggaaacaagcttcgaacgaggt

SEQ ID NO: 26859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaggtaatacgcgctctgcaggttcaacc

SEQ ID NO: 26860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaaggtactgatgatggatagacgagcggt

SEQ ID NO: 26861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagtagttcaaattcgtgaccaacgcctc

SEQ ID NO: 26862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagtgagcgcaaaagtcatcgggcgagcg

SEQ ID NO: 26863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagtgcagacgaagccccattgctcgctc

SEQ ID NO: 26864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaagtgcctgaaggtgccggcgggcgaagg

SEQ ID NO: 26865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaataaataggttagtgtataattgagtac

SEQ ID NO: 26866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatacaagtcgacaatgcgtttatcagtg

SEQ ID NO: 26867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatacttgttacttcctgtcttaggccaa

SEQ ID NO: 26868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatagaatggcgcagatgctgcaaatgta

SEQ ID NO: 26869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatagcgagcagcatgctggacaacgggc

SEQ ID NO: 26870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatatcgaggcttgtggctatacactgtt

SEQ ID NO: 26871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatatgcaggatcgcatcttgatttgtcc

SEQ ID NO: 26872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatattcggtcaacgtgtgtatttgctgc

SEQ ID NO: 26873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatattgagtgcaaatgtttaaggtgttt

SEQ ID NO: 26874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatcagccaacgttggtgcgtgggggctc

SEQ ID NO: 26875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatccgaaacctccgtcatccgtaacacc

SEQ ID NO: 26876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatccggtccacaatccgccgtccgtcca

SEQ ID NO: 26877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatcgagactcgctagatttactgcttcg

SEQ ID NO: 26878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatcgcatctaggacctgatctattttcc

SEQ ID NO: 26879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatcggagtgaggatttccttcggtcgat

SEQ ID NO: 26880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatcggatagtgtttaggccgcctggaat

SEQ ID NO: 26881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatgaatattgtacggtacaaatactttg

SEQ ID NO: 26882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatgatcgatcgccacgcacttggcccgc

SEQ ID NO: 26883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatgcaggcacatacgttttaggactgtc

SEQ ID NO: 26884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatgcatacggtggcaccttggaaatctg

SEQ ID NO: 26885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatgccatatcggtcgttcgtcccggtat

SEQ ID NO: 26886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatgcgtcagagctccagctcccggcgct

SEQ ID NO: 26887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatgctcgagttacaccttccaaaacggg

SEQ ID NO: 26888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatgggaatagaattgcattcatggcatt

SEQ ID NO: 26889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaatgtaagggattccatgcgaaaggttga

SEQ ID NO: 26890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaattccgtatacgctgtgccgattcctcc

SEQ ID NO: 26891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaattggccaagattcggtgttggtggacg

SEQ ID NO: 26892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaattgtggggacctccacttctttcccgc

SEQ ID NO: 26893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacaaaaagcgtcgatctttcctttacata

SEQ ID NO: 26894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacaaacgttcggatccggtattctggtcc

SEQ ID NO: 26895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacaaaggagctaaaggatgtcgttatggt

SEQ ID NO: 26896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacaaatctgagttacgcgttgtgtggtac

SEQ ID NO: 26897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacaacccggactctcttgcgttcggttgg

SEQ ID NO: 26898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacaacgcttgaatccgacaacggcaagat

SEQ ID NO: 26899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacaactttcatgatcagattaacgtgaca

SEQ ID NO: 26900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacaagatattatgctagtgcttttcttcg

SEQ ID NO: 26901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacaaggaacaaccaagcatcacacgtcgc

SEQ ID NO: 26902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacaatatggacgaagtggcagttgcaggg

SEQ ID NO: 26903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacaatcctgttgtccgtcgctctggcatg

SEQ ID NO: 26904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacacagcagtcgctcaaacgttcacttgg

SEQ ID NO: 26905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacacatctggttttcagacttctcctcga

SEQ ID NO: 26906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacaccctacagtgacaaaaacgctggttt

SEQ ID NO: 26907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacaccgatcgggacttgtcacttccgggt

SEQ ID NO: 26908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacacctgaacttggctagttattgtattc

SEQ ID NO: 26909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacacgacactcggccaagaagcggcgttc

SEQ ID NO: 26910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacacgcgcacgtttggggtggtcagcgtt

SEQ ID NO: 26911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacacgtactttgcctactagctgcataca

SEQ ID NO: 26912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacacgtgtgtgaggggcgagtggcgtagg

SEQ ID NO: 26913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacactaagaggtttcaacttagaggtttg

SEQ ID NO: 26914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacactccaagaagacgaaacgctgtggtt

SEQ ID NO: 26915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacagagggcatttgaacttaacggggctg

SEQ ID NO: 26916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacagccaccgataatagcccgcttggata

SEQ ID NO: 26917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacagctgaacttacccgtagctaacgcgc

SEQ ID NO: 26918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacagggaaaaactgaacagtggtgtgaca

SEQ ID NO: 26919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacagtactgcttaaacttaaacggggtga

SEQ ID NO: 26920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacagtcaggtaatcgtatcatgctttggt

SEQ ID NO: 26921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacataaatgtctgcctcacggtacggggg

SEQ ID NO: 26922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacatagatgctcgcgtgccttggactcgg

SEQ ID NO: 26923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacatagcattccaccctctcgttggtcct

SEQ ID NO: 26924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacatagggaacgtagtttaaacgcctcct

SEQ ID NO: 26925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacatcacgactactgacgaagcgggggcc

SEQ ID NO: 26926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacatccgatgccagcggaccgatcctcta

SEQ ID NO: 26927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacatgatgccccggtttcactccgctagg

SEQ ID NO: 26928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacatgccggccgtttgtgtcccgcgagca

SEQ ID NO: 26929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacatggggcctcagtgccgtaaagttgat

SEQ ID NO: 26930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacatgtagggtgacctctcgagccgttag

SEQ ID NO: 26931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacattcccgctaccccgattttctcgtcg

SEQ ID NO: 26932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacattcgccccaagacttcggagtacggt

SEQ ID NO: 26933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacattgctcagctccaaccatagtgcgtg

SEQ ID NO: 26934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccaacgccgggtaaaccatccgcctgct

SEQ ID NO: 26935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccaagatttccgcggaacctctgagctt

SEQ ID NO: 26936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccactcgggttagtcgctttgtttgcgt

SEQ ID NO: 26937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccagatgcatattttgtacctggggttc

SEQ ID NO: 26938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccagattgggagttgtctggccactcgt

SEQ ID NO: 26939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccagcatggcgaggcaaacaaagaggat

SEQ ID NO: 26940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccaggaactcgctacacctggcgttacc

SEQ ID NO: 26941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccatcaggcattcttggacgacccgcgt

SEQ ID NO: 26942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccatgggcctggacgtctgttcagtccg

SEQ ID NO: 26943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccattatttcctgtagttcaccggcata

SEQ ID NO: 26944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacccaattgcgattacagcgaacttgcgt

SEQ ID NO: 26945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccccaagcaccagctgattggcgcactg

SEQ ID NO: 26946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacccccgcatggatctttcccacctcggc

SEQ ID NO: 26947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccccgagcattgtgagcacccggctgag

SEQ ID NO: 26948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacccgcaccgattagtcgaagccccaggc

SEQ ID NO: 26949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacccgcgtaatgagtatggcgtgcagatg

SEQ ID NO: 26950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacccggcagcgctttaatccgcaactggg

SEQ ID NO: 26951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacccgggagacggtgttgttcgagggttt

SEQ ID NO: 26952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacccgtgatttccactgacctgaacaggt

SEQ ID NO: 26953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccctggaggtctccgttacgcaaatgcg

SEQ ID NO: 26954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacccttcaatgtgcttgattcgccgcggg

SEQ ID NO: 26955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacccttctcggttcttcctagatagagag

SEQ ID NO: 26956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccgaagccagtagttgccactttatgat

SEQ ID NO: 26957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccgactttacgggatgtggtacgagctc

SEQ ID NO: 26958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccgagtccctcctgcggcgagtcctcgc

SEQ ID NO: 26959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccgatcgaactttggctctagctcggcg

SEQ ID NO: 26960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccgatcggggagggctgcgctgaagctg

SEQ ID NO: 26961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccgcacgtaacagcgcaagttcgaggta

SEQ ID NO: 26962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccgcagtttacgcgcagactaggccgtt

SEQ ID NO: 26963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccgccaacgggtgcatcatattgcgtta

SEQ ID NO: 26964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccgctcctcggacacctttgcactggtc

SEQ ID NO: 26965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccgctggctatatgccggtgtctgtgtg

SEQ ID NO: 26966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccggcatcctccgtatagttccgcggtt

SEQ ID NO: 26967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccggggcaagcgcgtcttgggatgaatc

SEQ ID NO: 26968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccggtgcaatggcttcctgtgtaaagga

SEQ ID NO: 26969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacctacaggaatgctgatccaggcacatg

SEQ ID NO: 26970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacctattgcctgcagagatgtatggcgcg

SEQ ID NO: 26971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacctattggcgaatttatatcagtgcatt

SEQ ID NO: 26972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacctcatcgtatgctctggtggcactgtc

SEQ ID NO: 26973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacctctctaagcgggcggttagacaagcg

SEQ ID NO: 26974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaccttgttttcggccgggtattgttcaca

SEQ ID NO: 26975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgaaatgatctactagcggaacaagccc

SEQ ID NO: 26976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgaacgatgatctagcgcgttaaggcgt

SEQ ID NO: 26977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgacaccggccgtcgcacccacagccat

SEQ ID NO: 26978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgaccagagcatacctcgctacacttgt

SEQ ID NO: 26979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgacgggagccaattatggacgccgggg

SEQ ID NO: 26980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgacgggcgcgggcggcacttaggtgac

SEQ ID NO: 26981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgactaagacgccgaaagttatagttta

SEQ ID NO: 26982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgactcgccagccagggagacgtggtgt

SEQ ID NO: 26983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgactgggctgaaaccatatgctgttcc

SEQ ID NO: 26984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgagcacagttcgctctacagtcgtcgc

SEQ ID NO: 26985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgaggcaaatattcgacacgcgtccctg

SEQ ID NO: 26986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgagggccacaatttccccgtctaggat

SEQ ID NO: 26987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgatgagggttacagagatgctgctgtt

SEQ ID NO: 26988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgatgcaatggtagccggcgaatggcgc

SEQ ID NO: 26989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgatgttaggggtcgcttccaaccccgt

SEQ ID NO: 26990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgcaccaatgaacagacaccggagggcc

SEQ ID NO: 26991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgcacggtaaggaagtcttttacggata

SEQ ID NO: 26992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgcatctatggctgtgaagcggtggctt

SEQ ID NO: 26993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgcgacgttcacatggttctcctgtgtt

SEQ ID NO: 26994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgcgagccatttccaccacgtatgtatt

SEQ ID NO: 26995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgctcaatcatgcgaataaacatatcta

SEQ ID NO: 26996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgctcgggttgtacgttcaggtaattct

SEQ ID NO: 26997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgctggatcaatcgacgttccatgttcc

SEQ ID NO: 26998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacggactggtcgtatacccgctgcatggc

SEQ ID NO: 26999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacggagcaacttattatgctggtatataa

SEQ ID NO: 27000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacggagcatggatctcagaaggattcggg

SEQ ID NO: 27001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacggatgaattgatcacgtgatttgggag

SEQ ID NO: 27002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacggcagcggtcctggcacacgacttcta

SEQ ID NO: 27003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacggcattggacatggatcacttctggcg

SEQ ID NO: 27004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacggctaaagatgcgtcgggagacacaga

SEQ ID NO: 27005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacggggacgctttgacctgattttccgcg

SEQ ID NO: 27006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacggggtcttgtaggacaaatctcttggc

SEQ ID NO: 27007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacggtaccgacggcgtcaatccgcagggt

SEQ ID NO: 27008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacggtacgggagacgcagccgtaaacacc

SEQ ID NO: 27009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacggtttaccaagcatgcgcaactctgta

SEQ ID NO: 27010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgtaccacggatcggatggcctgccgga

SEQ ID NO: 27011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgtagagggttcgataatggatggaatg

SEQ ID NO: 27012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgtcctcgttactcataccgggttaggg

SEQ ID NO: 27013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgtcgcctttcactgtcacgtggtgtat

SEQ ID NO: 27014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgtgcacacggactagtgatgcgttgat

SEQ ID NO: 27015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacgtgggttaaagccctagcatagacgac

SEQ ID NO: 27016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactatggaaaacgctgatgtcggccattg

SEQ ID NO: 27017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactattgggacggtgagaacgcgaattcg

SEQ ID NO: 27018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactatttacatgcatgtgatggtatcctc

SEQ ID NO: 27019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactcaccatgaaacgtgtggctttggaat

SEQ ID NO: 27020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactccacggttcattcgcagaactggacg

SEQ ID NO: 27021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactccgaattttgtcattcgcggcgggta

SEQ ID NO: 27022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactcgctgttcggcctgctctgggatttt

SEQ ID NO: 27023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactcgtggaatcgtaggcaggcgggcacc

SEQ ID NO: 27024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactctcatctgaggcactgcggcgactgg

SEQ ID NO: 27025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactgcaacttgtgcctcgctacagtgggt

SEQ ID NO: 27026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactgcacaggctgatgacgatgactggcc

SEQ ID NO: 27027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactgcggactggtttgtcgcactgtagac

SEQ ID NO: 27028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactgcgtacataacggatctttgtctacc

SEQ ID NO: 27029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactgctactgctctagaataacttgcccg

SEQ ID NO: 27030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactgctactggggacctccgaatcagtca

SEQ ID NO: 27031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactggccaaaacgggagttgtgcctctcg

SEQ ID NO: 27032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactggttttgaggataacaggaatatgac

SEQ ID NO: 27033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactgtagaactccgtcctccatgacttgc

SEQ ID NO: 27034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactgttgacggcagtccccgattcccagg

SEQ ID NO: 27035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacttattgcattatttgctcttacgcggg

SEQ ID NO: 27036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcacttattgtcgggggcggagtacgttgct

SEQ ID NO: 27037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcactttggttttttcttttacctgccagtt

SEQ ID NO: 27038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagaaaacgacggtaattgtacgctccctt

SEQ ID NO: 27039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagaaacccgactggctcgttgccgttttt

SEQ ID NO: 27040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagaacagccagaagtagcttaaccagcgg

SEQ ID NO: 27041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagaacagtgtgagcgtcaatatttctgcc

SEQ ID NO: 27042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagaagcaccggatgaagcggacggagacg

SEQ ID NO: 27043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagaaggtacgtggatatcctattcggtac

SEQ ID NO: 27044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagaatgaccaagatgaggccatcatttgt

SEQ ID NO: 27045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagaattccatacgatctgacccccgcgcg

SEQ ID NO: 27046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagaattgcctggagggctgcgatggtttg

SEQ ID NO: 27047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagacaccggcttgtacaggagatggtact

SEQ ID NO: 27048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagacacggaaggtacagagtcccacgtcc

SEQ ID NO: 27049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagacaggatgaagggtcgggccgatgcga

SEQ ID NO: 27050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagacataacgtagtttcggttatgccacc

SEQ ID NO: 27051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagaccgaattcgtccaggtagagaacgcc

SEQ ID NO: 27052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagaccgcggcggcgagaattgtggatgtg

SEQ ID NO: 27053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagacctggtcgagttcggagtaagcttgg

SEQ ID NO: 27054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagacggcgtgattttgataactcgttacg

SEQ ID NO: 27055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagacgggaaggcctacggtagctcatgca

SEQ ID NO: 27056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagactcacaatgggcaagctgacccggtt

SEQ ID NO: 27057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagactcgaactttaagtcaccacggaaca

SEQ ID NO: 27058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagactgtggtgtctgagtacctcgtggtc

SEQ ID NO: 27059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagagaacgggacaatagaactcacgtgca

SEQ ID NO: 27060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagagaccgagatgctggtcagacagtccc

SEQ ID NO: 27061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagagaccggtcaccgcaacgtgtatgcca

SEQ ID NO: 27062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagagagtgtggcatagttcgtgcccgttg

SEQ ID NO: 27063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagagcaaatacatcgccaacggattccgc

SEQ ID NO: 27064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagagcggcgttgcacgagtttttggctgt

SEQ ID NO: 27065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagagctgcacacatagggattgcctcgtt

SEQ ID NO: 27066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagaggaattggggctagacccacagcact

SEQ ID NO: 27067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagaggcgtaccctgacagtcaattaggcg

SEQ ID NO: 27068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagagtaaggaagcaacttagggcgtggtg

SEQ ID NO: 27069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagagtatggccgcagcttagcactaactg

SEQ ID NO: 27070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagagtattcctggcgcccttcaggcgtgc

SEQ ID NO: 27071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagatatgctctcgccacggtaaagcggat

SEQ ID NO: 27072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagatatgtttcgacaggattcccgctgcg

SEQ ID NO: 27073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagatattgcggtattccctcccgtttcac

SEQ ID NO: 27074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagatctagaccattcttgacaatccggta

SEQ ID NO: 27075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagatgatatgcttgacgacccgcgttccg

SEQ ID NO: 27076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagatgcagagcacaggcaacgttttcctc

SEQ ID NO: 27077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagatgtggccggcggctggcacagagttt

SEQ ID NO: 27078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcaaatccttcactaggcttctcggggt

SEQ ID NO: 27079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcacatggagattatcggctacgtatgg

SEQ ID NO: 27080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcagacgaggtgttggtttgagcttgga

SEQ ID NO: 27081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcagacggatttgctccccggcttcgta

SEQ ID NO: 27082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcaggagtggcaatgttggttcgggctg

SEQ ID NO: 27083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcaggatattatcttggtaggctttcgg

SEQ ID NO: 27084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcatacgtggagggtgtccaacggtggt

SEQ ID NO: 27085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcatagttgaacgaggtggggattgggc

SEQ ID NO: 27086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcatattatctctcatcgtcttatgggc

SEQ ID NO: 27087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagccacatagtcgtggtgtcctagggtgt

SEQ ID NO: 27088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagccagcccgttgaggtcaatgggacgta

SEQ ID NO: 27089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagccagcggtcatctcacgagccccaggg

SEQ ID NO: 27090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagccccgactttaggttggggacggcgac

SEQ ID NO: 27091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcccgaaatcaccttccaaccagctttg

SEQ ID NO: 27092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcccgtctgcattaatcaggggtcaacg

SEQ ID NO: 27093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagccgagcttttaacccccgcagacgtct

SEQ ID NO: 27094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcctctccctgtttcaagcggtgcggcg

SEQ ID NO: 27095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagccttcattttgcccggctctattggat

SEQ ID NO: 27096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcgagccaaccaaaacataaagggccta

SEQ ID NO: 27097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcgatggtgtgtgcctgttcgacgattt

SEQ ID NO: 27098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcgcaccccagggtcttagctcctgtgc

SEQ ID NO: 27099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcgcacgattagccgtagagcacacgtt

SEQ ID NO: 27100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcggaagacttacgggcgtctagggacc

SEQ ID NO: 27101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcggagatataattactcggtaatgccg

SEQ ID NO: 27102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcggataggtatgagcccacgattacgg

SEQ ID NO: 27103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcggccgggggtagagctgttcatgaga

SEQ ID NO: 27104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcggcttcaatccagcatctgagctcta

SEQ ID NO: 27105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcgggattcttcctcggggtggtcgcac

SEQ ID NO: 27106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagctaccgtgttgtgtacattcaccttat

SEQ ID NO: 27107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagctatcggtaagggaagtttggtactac

SEQ ID NO: 27108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagctatctgtctaatcgcccatgcttatg

SEQ ID NO: 27109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagctcattggttattacggtttggccacc

SEQ ID NO: 27110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagctgaagtggggcaccgagggaatgacc

SEQ ID NO: 27111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagctggggtttggagtcttggccatcttg

SEQ ID NO: 27112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagcttcacttagggtggattgtatcggaa

SEQ ID NO: 27113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggacacgcaaccgagttcaacaaacgct

SEQ ID NO: 27114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggacgagaaccgtcggttgtgaggagat

SEQ ID NO: 27115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggacgtttgacggcgaggattatccgat

SEQ ID NO: 27116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggactcagagctaggactgcagtgcctc

SEQ ID NO: 27117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggagggacgggagcgcactgaccaaggt

SEQ ID NO: 27118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggagtcgggcgggggttctgcatgcttt

SEQ ID NO: 27119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggatcacgccgagtacatatgtcagccg

SEQ ID NO: 27120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggatgcctgcaaggtcggtctggaaggg

SEQ ID NO: 27121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggatgtacgtttacttgacggtgggacc

SEQ ID NO: 27122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggcagggtagcggtggtgtgcctgtttc

SEQ ID NO: 27123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggccctcgggagatacggtcgttagtta

SEQ ID NO: 27124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggcgatatttgtgtgggggtgcctcagg

SEQ ID NO: 27125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggcgcacgatctcgggtccttgcctttt

SEQ ID NO: 27126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggcgtaaatgcacacgaagggtggctca

SEQ ID NO: 27127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggctggacactgattaccgcgcgcttga

SEQ ID NO: 27128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagggaagtaggggtttgagcattagcacg

SEQ ID NO: 27129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagggataattggggtggcacagggcgcgt

SEQ ID NO: 27130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagggccataccagccaacccttcgttgct

SEQ ID NO: 27131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagggcttaggactccggcactaccgttgg

SEQ ID NO: 27132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggggggtgactagtcgtccagttgtttt

SEQ ID NO: 27133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggggtggcggcttcttgcgcgtctgtgt

SEQ ID NO: 27134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagggtaggtaatatggccccgccgggctt

SEQ ID NO: 27135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggtaaccccgtaagtcgtctaccggtat

SEQ ID NO: 27136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggtaatacttgacaaccagtttattgct

SEQ ID NO: 27137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggtcacgcggggagtagggccaagcatt

SEQ ID NO: 27138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggtccatcgcgtgggggttgaatccatg

SEQ ID NO: 27139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggtgaggcggctctgttagccctcgtgg

SEQ ID NO: 27140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggtgtacgaatattcctgccactgatga

SEQ ID NO: 27141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcaggtttggtgaccgcgtatcgtagccaga

SEQ ID NO: 27142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtaaaatttgcacagtccgttctccgga

SEQ ID NO: 27143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtaagccgttggactgccgatccgtacg

SEQ ID NO: 27144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtaatggtagctaggcgggtctcggagt

SEQ ID NO: 27145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtacaaaccatggggtctacgcgcgagt

SEQ ID NO: 27146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtacacctacgctaggatctcttgtccc

SEQ ID NO: 27147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtacatctcatgtaacctggcgcttgta

SEQ ID NO: 27148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtacatgctgattaccccggggggcact

SEQ ID NO: 27149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtacccagggccggtgaagtttgggtcg

SEQ ID NO: 27150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtagcgtttaatgtagggatttaaaccg

SEQ ID NO: 27151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtatcttcaccgaggtgcagtataggta

SEQ ID NO: 27152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtatgaccaatctgaggtagtatgagtc

SEQ ID NO: 27153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtcaacgcagcaatgtatcaaagagtcg

SEQ ID NO: 27154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtcacgtctcaagtcgatggggaccata

SEQ ID NO: 27155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtcatcagatatattctagtgccctgga

SEQ ID NO: 27156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtccagggcatcgagttcttgcttttcc

SEQ ID NO: 27157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtcccaagtcatttctcgataccgtgtc

SEQ ID NO: 27158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtccccggaatagcgagttaggcctgag

SEQ ID NO: 27159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtccgagtttatccttttgcaggttcgt

SEQ ID NO: 27160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtccgcttgggccatcagccggaccggc

SEQ ID NO: 27161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtcctgggcccaccagtaaggcacggta

SEQ ID NO: 27162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtcgacgcaggcacaaaatcctgtggta

SEQ ID NO: 27163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtcgtcatcctttccgcgatcctcaccg

SEQ ID NO: 27164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtcttagttggggcctcgtcattactgg

SEQ ID NO: 27165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtgaaaaatgaggggtagatgagcaagc

SEQ ID NO: 27166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtgaggttaaagaatcgcgtaccacggg

SEQ ID NO: 27167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtgcatggaaaggtggctgtcccgtttc

SEQ ID NO: 27168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtgccttttgcagcattcgtgaactggt

SEQ ID NO: 27169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtgggagggatgcgtcggttaggctacg

SEQ ID NO: 27170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtggtcgacgaggtacgtacagccgtct

SEQ ID NO: 27171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtgtacagccctactctttctttattcg

SEQ ID NO: 27172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtgtagggtccaaattgccatgacaggc

SEQ ID NO: 27173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagtgtcgggggtatgtcactgatgctggt

SEQ ID NO: 27174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagttatcgatgccgaccaaagcggacacg

SEQ ID NO: 27175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagttcgactccacccacgtcactcaagct

SEQ ID NO: 27176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagttcggacgatgtcgcctgtcagcgcga

SEQ ID NO: 27177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagttctaagtttgttgttttctttattaa

SEQ ID NO: 27178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagttctcgccacggagcttgtttagattg

SEQ ID NO: 27179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagttctcttaggccggggcagggggtcta

SEQ ID NO: 27180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcagttgcggagtagggaatatggaaccagt

SEQ ID NO: 27181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcataaatggcctcagcagtgtcggtggtga

SEQ ID NO: 27182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcataacaacttgctatacgagctcgtctgt

SEQ ID NO: 27183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcataagattttgggttagggcacttcccct

SEQ ID NO: 27184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcataagttggtttgggaaccgggtcccggg

SEQ ID NO: 27185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatacacagatcgaccgggaccccgatttg

SEQ ID NO: 27186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatacactatcttgccctagcggtcggctc

SEQ ID NO: 27187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatacactgcacgccttcaccgcgtcggtc

SEQ ID NO: 27188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcataccatcggcatgaagctcctccctatc

SEQ ID NO: 27189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatagagggacaatcaatcacctcaagctc

SEQ ID NO: 27190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcataggcggaaatcatggaaacgcgggttg

SEQ ID NO: 27191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcataggcgttacaggactacacatcaatgg

SEQ ID NO: 27192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatatgtccatacccgcatccgacctgtcg

SEQ ID NO: 27193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatatgtttttaccattcaacaaaccgtcc

SEQ ID NO: 27194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatatttttttggtgcacgtcgtttggcgg

SEQ ID NO: 27195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcaacgttttaggcccgtttattctgat

SEQ ID NO: 27196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcaagacgccgatcaatgatcccatcac

SEQ ID NO: 27197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcaagtgttcttcgtttggattacctgt

SEQ ID NO: 27198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcaatcaaatctggtgtacaccgatacc

SEQ ID NO: 27199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcacagcaggctcggaggctagcaactg

SEQ ID NO: 27200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcacagggcctgtagcacgactcgcttc

SEQ ID NO: 27201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcaccgattcatgagtgtcccgtattag

SEQ ID NO: 27202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcaccttctcattaggttctgtcgcggc

SEQ ID NO: 27203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcagagtccattagccgcatggattacc

SEQ ID NO: 27204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcagccgttttgtctcgagggttacacc

SEQ ID NO: 27205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcagtgtgttgaatcgaatggtggcccg

SEQ ID NO: 27206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcattggttttttggggtaaggatgggc

SEQ ID NO: 27207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatccatcgtgcgacccgaagcacacggag

SEQ ID NO: 27208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcccggggtcagctcggggtccgagcgc

SEQ ID NO: 27209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcccgtgatccttccccccagctttggg

SEQ ID NO: 27210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcccgttgcttcacgatgtcatcctgtt

SEQ ID NO: 27211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatccctgtcaccgtgcgtcacagctgcct

SEQ ID NO: 27212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcccttggcgaatattactgaactgctc

SEQ ID NO: 27213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatccgcgaaaagggaaagtaataatcttt

SEQ ID NO: 27214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcgaattctagctggaatatgacacggg

SEQ ID NO: 27215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcgaccatcgcacctgttgctaggtccg

SEQ ID NO: 27216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcgacttcatgcaactgagagcgactgc

SEQ ID NO: 27217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcgatgtggccctaaccgggaggacatg

SEQ ID NO: 27218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcgcccaacgtgaacaattgcgggccgg

SEQ ID NO: 27219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcgcccatcgacattttcaccggtgtcg

SEQ ID NO: 27220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcgggtactgcggtcaaccctatcttgc

SEQ ID NO: 27221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcggtcccaaccgggaggatctgctttt

SEQ ID NO: 27222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcgtacactcgggctggtcggtactccc

SEQ ID NO: 27223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcgtctagcactcacggtcgaccgtccg

SEQ ID NO: 27224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatctcattaggttttagtaatggcatagg

SEQ ID NO: 27225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatctctagggggccaaccttcgaggtctt

SEQ ID NO: 27226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatctctgtcctagccttctgagatcaatg

SEQ ID NO: 27227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatctgtacccaatgtttcgtgtgcccgcg

SEQ ID NO: 27228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatcttccgtatcgcatcggtccgttaatt

SEQ ID NO: 27229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgaaagcttaggattggtcattattcgg

SEQ ID NO: 27230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgaatgtacagatggcatctcagctagg

SEQ ID NO: 27231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgacatgtggatagcatttgcagcagca

SEQ ID NO: 27232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgagggtggtaatcgtatgctatgggga

SEQ ID NO: 27233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgagggtttcttggcttccaaccgtttg

SEQ ID NO: 27234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgatcggcgacaattagcggcaataggc

SEQ ID NO: 27235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgatcttctcagttgtacggggcgcttg

SEQ ID NO: 27236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgattcactttaagttgttcgcaatgtc

SEQ ID NO: 27237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgatttttcgcaccagtgctaattggct

SEQ ID NO: 27238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgcaagacgagcgggcttgcgcaccacg

SEQ ID NO: 27239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgcaatagtctcgaccccctgtgtaaca

SEQ ID NO: 27240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgcacgcatatccagagtggcgacaccg

SEQ ID NO: 27241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgcagagtaacacggggttctaaagccg

SEQ ID NO: 27242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgcaggctatgtagtgaggaggagtagt

SEQ ID NO: 27243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgcagtaatatgctcacaactcagtggt

SEQ ID NO: 27244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgcgacacggctcttgggggcagcttac

SEQ ID NO: 27245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgcgcaccgttctaatatcggtgtgagg

SEQ ID NO: 27246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgcgctgactttcttaggcccggggggt

SEQ ID NO: 27247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgcgttgggatccgagaccttactaact

SEQ ID NO: 27248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgctgaatgccacaaccaatacacaacg

SEQ ID NO: 27249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgcttgttccattcggggccttgacgag

SEQ ID NO: 27250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatggcaatcgtgacttcggtgggtatttg

SEQ ID NO: 27251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatggcactcgtttctttgcgtatattctt

SEQ ID NO: 27252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatggccactacgctattacattgtttaat

SEQ ID NO: 27253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgggctccaaggctttttgcgtcggtcg

SEQ ID NO: 27254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatggggcgatgcggtaatggcgtaccgtg

SEQ ID NO: 27255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatggtggtctcttgtccatggctgggttt

SEQ ID NO: 27256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatggtggtggtggcgactcggtaacaggt

SEQ ID NO: 27257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatggttccagctcttccctctagcggagg

SEQ ID NO: 27258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgtaaatcttcggaagggccccccactg

SEQ ID NO: 27259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgtagtagaagattccgggggttggcgg

SEQ ID NO: 27260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgtcacagcaatccttttttgttgtgct

SEQ ID NO: 27261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgtcagcatgagccacgtatgagcgccc

SEQ ID NO: 27262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgtcggccgacaggaggattctagacaa

SEQ ID NO: 27263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgtgggcgacgtacactggtgtttgatt

SEQ ID NO: 27264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgtggtggccacgacatgattgcccttg

SEQ ID NO: 27265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgtgtgtaccgggggtcgtttgccgggt

SEQ ID NO: 27266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgttatcgtggtacggctggggagtggg

SEQ ID NO: 27267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgttcctgcacacattcgactgggccac

SEQ ID NO: 27268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatgttgctcaagctcgaccagcattgctg

SEQ ID NO: 27269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattaaaacccggacaatcactacggattg

SEQ ID NO: 27270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattaaccgtacttgccgtggcgcgactgg

SEQ ID NO: 27271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattaacctgccgtgggaccctccgtgtga

SEQ ID NO: 27272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattagcgtgccaataaagagatgcgtaac

SEQ ID NO: 27273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattaggtgatgtacgatcccgggacagtc

SEQ ID NO: 27274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattcaatcgacttttgggggacacctgct

SEQ ID NO: 27275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattccagacagtgctacccctcgcggcta

SEQ ID NO: 27276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattccggtcccaaaggctccgtatgtgtt

SEQ ID NO: 27277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattcctaggcgtacccttcccggttaggt

SEQ ID NO: 27278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattcgacggtttgcgggtaggggggtata

SEQ ID NO: 27279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattcgcctggttgcagcgggtgccggccg

SEQ ID NO: 27280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattcggacatgcttgcgtctctgggatcc

SEQ ID NO: 27281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattcggtgcacacggaccctgacgctgcc

SEQ ID NO: 27282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattcgtcggttatgctatggctggggaca

SEQ ID NO: 27283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattctccctggagtggcgccgatcgcgcg

SEQ ID NO: 27284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattgacctttaatctgcccgggcggcgag

SEQ ID NO: 27285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattgagcgcgcgtatgtatcacatttggt

SEQ ID NO: 27286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattgcatcgttatatcaccgtcgggccgt

SEQ ID NO: 27287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattggccctcatcgttgtgaagtcccgta

SEQ ID NO: 27288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcattgggaatagggaaggaacaatcacccc

SEQ ID NO: 27289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatttcgcatgaggatcagtcaggttgggc

SEQ ID NO: 27290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcatttcgttatccctggcatatttcggcac

SEQ ID NO: 27291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaaaaacaacggtgattcattgtgatctc

SEQ ID NO: 27292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaaaacgtggcgagcgaacggctagcaac

SEQ ID NO: 27293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaaaagtcacacgtccatgtaagcataag

SEQ ID NO: 27294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaaacagaaaggtggactgagttatcgat

SEQ ID NO: 27295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaaacgggtgtagtaaggttatccggttc

SEQ ID NO: 27296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaaacttgcgtaagtatatgaacacgccc

SEQ ID NO: 27297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaaagtactcgtgtgttgctcgatctcgg

SEQ ID NO: 27298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaacaacccactcgacagggctcgcctta

SEQ ID NO: 27299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaacacctcgtactgcgcgcccagcttag

SEQ ID NO: 27300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaacaggattgagtatgctgctggatacg

SEQ ID NO: 27301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaaccgttcattcacgatgggatacttgt

SEQ ID NO: 27302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaacctaatcagactcgattcgcgaaggg

SEQ ID NO: 27303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaacgacaagctcgtctaaatcgaattgg

SEQ ID NO: 27304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaacgatcccatttcgtctcattaatcgc

SEQ ID NO: 27305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaacgcccatcgcacgacagtgtctaaac

SEQ ID NO: 27306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaacggagtgtacgatgtatatcaatgtt

SEQ ID NO: 27307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaacttgggactctgcgtcgtacgtacac

SEQ ID NO: 27308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaagatggccgcatgcttcttgctctcgg

SEQ ID NO: 27309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaagcacgggtcagtgcgctggggcaagc

SEQ ID NO: 27310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaagcgttcgccaggatttatcggtttgc

SEQ ID NO: 27311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaagctccccacctggtgtagccagtacc

SEQ ID NO: 27312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaagctgagacatcgggcgtgagtggggc

SEQ ID NO: 27313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaagggttgttagctctagttcgatcagc

SEQ ID NO: 27314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaaggtgtgttgacctgtgctttgcttgg

SEQ ID NO: 27315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaaggttagatttacgttttaactgtagt

SEQ ID NO: 27316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaagtccaaagctaacctgcgctggacga

SEQ ID NO: 27317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaagtcgaacgttccttcattgctattaa

SEQ ID NO: 27318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaagtggacttcactaagagaatgtgtcc

SEQ ID NO: 27319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaatcagcgtttctgtacgcgttggctgg

SEQ ID NO: 27320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaatgcgttactgccagttggacgatgca

SEQ ID NO: 27321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaatgtacttttacttcccttggtcttag

SEQ ID NO: 27322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaatgtagggtctccgggtctctaaggcc

SEQ ID NO: 27323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacaagttacctgcgatcggctttaccta

SEQ ID NO: 27324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacacaaaatggcccggtcagaccttatc

SEQ ID NO: 27325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacacaaggtaccgattctggtgtataga

SEQ ID NO: 27326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacagaacattttgggaggctatcatgtt

SEQ ID NO: 27327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacagacatgcacaaggagtttggacaca

SEQ ID NO: 27328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacagcaatccgtgatgttgaaaggtccg

SEQ ID NO: 27329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaccacagggaactcgactgcatggtcgt

SEQ ID NO: 27330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaccagactcgtacgagcgggcgattgtt

SEQ ID NO: 27331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaccaggggactcatgaccccgacgggat

SEQ ID NO: 27332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacccgagctcattagcgtgaccgatacg

SEQ ID NO: 27333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacccgcggtttactacgttggccaaatg

SEQ ID NO: 27334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaccgcctttttctaccatgactggtagg

SEQ ID NO: 27335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaccggaaagtgattgagaccagatcgta

SEQ ID NO: 27336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaccggcagtagcttcctgcccccgccgc

SEQ ID NO: 27337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaccgtaacgcggtttattaacgagggct

SEQ ID NO: 27338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaccgtacaggcgggcgtcatcgggttcc

SEQ ID NO: 27339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaccgtacttctagcactaaattccccat

SEQ ID NO: 27340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaccgtctcgaagaaaccgcggacagtca

SEQ ID NO: 27341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaccgtgatttcattcccccactatcgac

SEQ ID NO: 27342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaccgttcgctatgtgcagcgtctgagac

SEQ ID NO: 27343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacgaagagactatttggttgattttccc

SEQ ID NO: 27344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacgacaaacatcccaggacgctccacgg

SEQ ID NO: 27345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacgacacccgcatagaggctaaggccgg

SEQ ID NO: 27346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacgaccggccagagtacgccgaggtgtg

SEQ ID NO: 27347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacgatcacaagtgctagcggggacggtt

SEQ ID NO: 27348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacgcgagtaaggcactgtatctggcgcg

SEQ ID NO: 27349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacgctaccttggttcccagttcagcccc

SEQ ID NO: 27350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacgctcaaaatggtccacccgccattgg

SEQ ID NO: 27351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacgcttttgacttgctgtttatctcttg

SEQ ID NO: 27352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacggacggctttcatgtgacgaggaggg

SEQ ID NO: 27353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacggcctcgcaatttccggatgttatgt

SEQ ID NO: 27354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacgggcctacaacactgtttcacacttt

SEQ ID NO: 27355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacgtcacacatcacgagagggcttttgg

SEQ ID NO: 27356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccacgttgtatttcttcgtcgtagagggtg

SEQ ID NO: 27357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccactcaacccgacatgtaaggcactcggg

SEQ ID NO: 27358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccactcagtcacaccgtgacataaagcacg

SEQ ID NO: 27359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccactcatttcgtcggtggttatgagccgg

SEQ ID NO: 27360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccactgggaccagatatgtagtgtaggacg

SEQ ID NO: 27361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccactggggtgcacgtgttctgcccacgat

SEQ ID NO: 27362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagacaatggaaaactcgtgccactcatg

SEQ ID NO: 27363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagacacacatctcttactttataggact

SEQ ID NO: 27364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagactgcataagcgcccttctgcataag

SEQ ID NO: 27365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagactggggtcggaaagtaactcactgg

SEQ ID NO: 27366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagaggatgtgaggtaaccagtgttgctc

SEQ ID NO: 27367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagaggtggcagccattcagcaagagccc

SEQ ID NO: 27368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagatgtgtcccgtgctcctagttcgcca

SEQ ID NO: 27369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagcaatcccaaatgtggtagttctcagt

SEQ ID NO: 27370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagcaatcgggttagttgtctcactgctc

SEQ ID NO: 27371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagcagtgggacggctcgcgcgttacggg

SEQ ID NO: 27372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagcatgcaactaatcgttgtcgtcgtcc

SEQ ID NO: 27373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagcatgttgaaacgcccaacggctttcg

SEQ ID NO: 27374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagcgaaataccggagacttgctacagcg

SEQ ID NO: 27375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagcggattgagcaaactgtttgggccta

SEQ ID NO: 27376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagcgtcacactgtagcccgccagccgat

SEQ ID NO: 27377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagctagagcctgattatgaaggtggcgg

SEQ ID NO: 27378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagctggtcgaggtctctctcatgcgacg

SEQ ID NO: 27379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaggagccatccctctgtccatgtcccgg

SEQ ID NO: 27380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaggagggtcgtgcgttttcctcttatct

SEQ ID NO: 27381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaggagtaggaggatccccgtttattgca

SEQ ID NO: 27382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaggcggttctaattcgtaaatggtgcgc

SEQ ID NO: 27383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccaggcttatgcacagtgtatcagtcccgc

SEQ ID NO: 27384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagggtgttaatgtgccgaactctgccct

SEQ ID NO: 27385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagggtttcgatctcgccgttacttggca

SEQ ID NO: 27386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagtagtaaaacgcgactaacctctaagg

SEQ ID NO: 27387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagtccgtcgctgggtcccttacgatagc

SEQ ID NO: 27388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagtcgcgatgaacgaacgatcgtcgtca

SEQ ID NO: 27389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagtgagggtagtacgcgcgtttcatttg

SEQ ID NO: 27390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccagtgttatcaccttgacccgcggctagg

SEQ ID NO: 27391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccataagctccaggagtggtaacgttcgcg

SEQ ID NO: 27392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccataaggctttaatgaaccgtcaactcta

SEQ ID NO: 27393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccataatatgcgttaggcaacatctcaccg

SEQ ID NO: 27394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccataccacaactcgctgtaacacagaata

SEQ ID NO: 27395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatacttcggtgcgtccgaggggttggtg

SEQ ID NO: 27396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccataggattacgatatgaaacgtgtactg

SEQ ID NO: 27397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccataggccgtctcccgtgtttctgcgtac

SEQ ID NO: 27398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatcaggaggaggttgttcccgcgacttt

SEQ ID NO: 27399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatcattttcgaaccgcgagtgcccgcga

SEQ ID NO: 27400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatccaatcgcaagcacgtcccgtcagcg

SEQ ID NO: 27401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatcgaaggaagcggagaacacatgccca

SEQ ID NO: 27402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatcgagagcgaacattcgtgtcaacata

SEQ ID NO: 27403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatcgtggtcgctccgctagatccaagga

SEQ ID NO: 27404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatcgttccaactcttggatggcgaacct

SEQ ID NO: 27405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatctgatacggtttctacatttggttgc

SEQ ID NO: 27406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatgagatttatgccaggtacgggcgagc

SEQ ID NO: 27407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatgcctacatgtcaccgactcgttacgc

SEQ ID NO: 27408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatgctatcgctccacatctcggggtggg

SEQ ID NO: 27409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatggggccggtgcagagaggagtcttga

SEQ ID NO: 27410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatggggtaacattcgtctgccatcttac

SEQ ID NO: 27411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatgtcctttgcccgggggtctgggtgat

SEQ ID NO: 27412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatgtgactagatgggccgcctcgaaggt

SEQ ID NO: 27413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatgtggggtgtgggtgacgctcgctctt

SEQ ID NO: 27414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatgtgtatatgcaagacggctcggagaa

SEQ ID NO: 27415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccattacccgggaccgcgtgttgaatgtgt

SEQ ID NO: 27416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccattatgcccagggggaattccggttagc

SEQ ID NO: 27417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccattcgataggcgtacagaagctttcccg

SEQ ID NO: 27418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccattgccactcgagccactgggttggtgg

SEQ ID NO: 27419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatttcagcaaatgtcacactcttgggac

SEQ ID NO: 27420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccatttgtgcagtagctagagtgatcatgc

SEQ ID NO: 27421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccaaacggccacttggtcccagtagcctg

SEQ ID NO: 27422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccaacgtactgttcaacggagttgtggtc

SEQ ID NO: 27423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccaagacatgaataattttcggcaggggt

SEQ ID NO: 27424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccaattcccgatacgagttgccgtatgtc

SEQ ID NO: 27425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccaatttctttacaaacgaaggttttgtt

SEQ ID NO: 27426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccacacaaacgcgtcgaaaatcgtcctct

SEQ ID NO: 27427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccacacgatttcaatagtgcgcagtggct

SEQ ID NO: 27428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccacagctaagggactgggacagcgggtt

SEQ ID NO: 27429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccacatatgtaagatgttgcttattcatt

SEQ ID NO: 27430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccacatctgtacatggcgtgcagaaattg

SEQ ID NO: 27431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccacgtatacgactgccgtttttgaagct

SEQ ID NO: 27432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccacgtgttcctgcgactcctcttcaccg

SEQ ID NO: 27433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccactgcggaagccgacgcatgtgttgaa

SEQ ID NO: 27434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccactgctcgatgctccggcttgatctcg

SEQ ID NO: 27435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccactgtcccaacactgagctggacgtcc

SEQ ID NO: 27436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccagactctccgttacagtggtcttgcct

SEQ ID NO: 27437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccagcgtgtctataacagtttacttgtgc

SEQ ID NO: 27438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccaggaagacctgccggcaacgtcgcagt

SEQ ID NO: 27439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccagtatgccgtttctcgtcttgggtacg

SEQ ID NO: 27440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccagttacgcaggcgttacatgccgtcat

SEQ ID NO: 27441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccagttttgcacaatcaagtaggacacgg

SEQ ID NO: 27442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccataccagctgccgtgccgggaatacgg

SEQ ID NO: 27443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccatactatcggtgcttccttttgaggcg

SEQ ID NO: 27444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccatggatgctcggaaagcactggaggct

SEQ ID NO: 27445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccattgaacaggtggtatggtggagcagg

SEQ ID NO: 27446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccatttcaccatgcttcgtcttctggcat

SEQ ID NO: 27447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccccaagagcccacgcgtgcatgatagtac

SEQ ID NO: 27448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccccaagcaaattggctggtgcacaggcgc

SEQ ID NO: 27449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccccaagcaatgtcacggtttggtccgtcc

SEQ ID NO: 27450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccccaatttgctcgttatgtacggcatggg

SEQ ID NO: 27451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccccacccgttaatttggtgttacccgtgc

SEQ ID NO: 27452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccccagttacttcattgagttccattcagg

SEQ ID NO: 27453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccccacggttagaccaacttacacggatc

SEQ ID NO: 27454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccccactcatgtccgtaagtcaactcccc

SEQ ID NO: 27455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccccgcaatcttctcaaagggcacaggca

SEQ ID NO: 27456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccccgggactatgcaatctgagattgagt

SEQ ID NO: 27457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccccctcgggtcctgctctcttccgtggtg

SEQ ID NO: 27458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccccgcactctgttgtacgcgacacgtgtg

SEQ ID NO: 27459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccccgctgttgctggctgacgcgttcacct

SEQ ID NO: 27460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccccggctcacatacgctgctcggagattg

SEQ ID NO: 27461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccccgtgcgcgtgacaatgaggcaatgggt

SEQ ID NO: 27462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccctaactgtattcatgcctgatccggat

SEQ ID NO: 27463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccctcatttcaattctgacggagtggtgc

SEQ ID NO: 27464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccctgatctagcgtatgcgttctagccgg

SEQ ID NO: 27465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccctgggccattggaccgggtcaaggtgt

SEQ ID NO: 27466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccccttaatgatgtcgtttgaccattgtgt

SEQ ID NO: 27467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccccttgtcaggatgctgatggaccaccgt

SEQ ID NO: 27468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgaaagtcacggaattggtagtggtggg

SEQ ID NO: 27469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgaacgcacgtattagtagaagggcggc

SEQ ID NO: 27470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgaagatcatcatttctaggcacagtcc

SEQ ID NO: 27471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgacctgagttgcccactcggtttacgt

SEQ ID NO: 27472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgaccttcttagccaaagctacaggtgc

SEQ ID NO: 27473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgagccaatcgagagactcttatccggt

SEQ ID NO: 27474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgagcggagaaggcaaattggagttcca

SEQ ID NO: 27475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgattgcttcttgtgctgcagagctttg

SEQ ID NO: 27476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgatttcgtggttcgctgcatgtccttc

SEQ ID NO: 27477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgattttttactagaatagtccctgcgt

SEQ ID NO: 27478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgcaacagtctaactagcagccgcagat

SEQ ID NO: 27479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgcaagaagactagctcctactcactcg

SEQ ID NO: 27480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgcaaggtttgagtggtcacggtggggg

SEQ ID NO: 27481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgccacttgcgcgaagaaaagcccaggc

SEQ ID NO: 27482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgccagccggtatggaaggccctgcgtt

SEQ ID NO: 27483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgccataggagatcgaaggggtacgagg

SEQ ID NO: 27484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgccgttgcactatcacggtctgcacgg

SEQ ID NO: 27485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgccttaaacgtcccacgtcagcacaag

SEQ ID NO: 27486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgccttacctcttcaacaatctatcctg

SEQ ID NO: 27487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgcgcgagaggaccctgctgctcggtac

SEQ ID NO: 27488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgcgcgctcgccagtcagagactgtaag

SEQ ID NO: 27489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgctggcacaaaatgcaaatgtacgcgc

SEQ ID NO: 27490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgcttcatgaagtctaggtgatcggccc

SEQ ID NO: 27491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgcttccccgtttcacctaccgcgtatg

SEQ ID NO: 27492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccggaacctgtagcctctgactcgctgct

SEQ ID NO: 27493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccggacgtcgtctttaattcccttcctcc

SEQ ID NO: 27494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccggagttaacatagcacgccttggaatc

SEQ ID NO: 27495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccggcatcccattatcctgttcgtgtccg

SEQ ID NO: 27496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccggcggatttggatgtcacagacgtgtg

SEQ ID NO: 27497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccggctcgatttgaagcatgtcacgggtg

SEQ ID NO: 27498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccggctgagaacgactgcgtatgaattgg

SEQ ID NO: 27499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgggtaggttttcgtgttgtgctgccgg

SEQ ID NO: 27500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgggtttagtgtgttccgcaatagttta

SEQ ID NO: 27501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccggttctctgttaggcacctagccggga

SEQ ID NO: 27502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgtcgcaagtgtatgatggtgtagcgcg

SEQ ID NO: 27503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgtcggaatatgtgattgcggtaacatc

SEQ ID NO: 27504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgtcgtccggtgtcagtcacacattccg

SEQ ID NO: 27505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgtgaacgacgttggcactacagatata

SEQ ID NO: 27506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgtgcaggcatggtggaacttcagtgcc

SEQ ID NO: 27507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgtggaagcctaatattgtgttggctac

SEQ ID NO: 27508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgtgtgtgcaaacagttaccccaggtta

SEQ ID NO: 27509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgtgttgttaccgttctgggcggtaagg

SEQ ID NO: 27510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgttaactgcaggttcggtagtccgtca

SEQ ID NO: 27511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgttcttgtgagaccatgtgccccgtta

SEQ ID NO: 27512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccgttggcacattccactttctccactga

SEQ ID NO: 27513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccctaacatactttacagctgcaccgggct

SEQ ID NO: 27514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccctagggggctcctcggtcggagaatgca

SEQ ID NO: 27515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccctaggtacagtccgtgttcgccacacga

SEQ ID NO: 27516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccctattcatgctaagttacttgggttacg

SEQ ID NO: 27517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccctattccagagaagcgggggtactaggc

SEQ ID NO: 27518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccctcaatcaggcctaatctgggtggtatc

SEQ ID NO: 27519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccctcatcgacagctttcggtccatctgat

SEQ ID NO: 27520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccctcattccccaggcgtcgattcacggct

SEQ ID NO: 27521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccctctgtcggtcaacatgactttgccggt

SEQ ID NO: 27522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccctcttcgccgtacgcatccggtatcatg

SEQ ID NO: 27523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccctgaactgcaagaggccagcggtttggg

SEQ ID NO: 27524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccctgcgaggaaccgtgcttacgctaccgt

SEQ ID NO: 27525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccctggcgtattgccctcgacatctcggcg

SEQ ID NO: 27526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccctggtattgaggaacctagttccccccg

SEQ ID NO: 27527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccttaatatggcccgttaggtagagcgta

SEQ ID NO: 27528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccttcaagttggtccagctggtcgtgcgg

SEQ ID NO: 27529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccttcggcctatagacggttaacgttcgt

SEQ ID NO: 27530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccttgaatgtgtgatcgcggccacagtcc

SEQ ID NO: 27531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccttgtatgttcgcaactaccgatgtgac

SEQ ID NO: 27532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcccttgtctcgttctctggccggcctcttg

SEQ ID NO: 27533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccctttcttatggcccgaactaccgagtac

SEQ ID NO: 27534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccctttgttttctcgcgtgggatgttaggg

SEQ ID NO: 27535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgaagcacagaggttggggtaacagaccg

SEQ ID NO: 27536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgaagctgaacctcatcctggcgtgtggg

SEQ ID NO: 27537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgaaggtcgtcgcagtgggctgatacgat

SEQ ID NO: 27538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgaagtccgaggagcgtgattagggtgcg

SEQ ID NO: 27539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgaagtgaggacttagttcgaaacgtggg

SEQ ID NO: 27540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgaataacgactccgttgctctttaggac

SEQ ID NO: 27541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgaatcgcgaatcaattcttccgggagcg

SEQ ID NO: 27542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgaattgacgttatccccaggcacggggg

SEQ ID NO: 27543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgacaggatggctgggttgtgaacgagcc

SEQ ID NO: 27544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgacatgaatccggagccgaactcccgta

SEQ ID NO: 27545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgaccctcaggcagccttgtcgacgttcg

SEQ ID NO: 27546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgaccgaaccgtgtccttcaaggcatggg

SEQ ID NO: 27547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgaccgagggagaatgcctttgggcgtat

SEQ ID NO: 27548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgaccgtggtttgtaaagcgccttgctac

SEQ ID NO: 27549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgaccgttgcgcaagtgctttttggatgc

SEQ ID NO: 27550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgaccgttggtcagctgggtattccttat

SEQ ID NO: 27551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgacgaccctgtgtgctgcgttgtttgcg

SEQ ID NO: 27552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgacgttccaggggtaagtcttttgtgcc

SEQ ID NO: 27553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgactaaaccctgcatgtgactgtcgggt

SEQ ID NO: 27554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgactgagttccgattgcacgcactccgg

SEQ ID NO: 27555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgactggtgggtgcccagcttatactgcg

SEQ ID NO: 27556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgagaaacgcttcattgttgagccggcta

SEQ ID NO: 27557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgagagatgggtgacagatatctccaggc

SEQ ID NO: 27558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgaggggggtgtaactgcgatggacgccg

SEQ ID NO: 27559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgaggtatgtcttgtccgccctagccctg

SEQ ID NO: 27560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgaggtcattcgaggtcgagacgaagccg

SEQ ID NO: 27561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgagtcggaagcgcgtaccctgctggtgc

SEQ ID NO: 27562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgagttttccgttccgcccggcaaggttc

SEQ ID NO: 27563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgataacgtactcgctgtccaggtacggg

SEQ ID NO: 27564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgatgcctgccacaacttccccttgtctg

SEQ ID NO: 27565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgatgctctgtgggcacgtgtttcagcca

SEQ ID NO: 27566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgattcctagtctttagtgtttgcattcg

SEQ ID NO: 27567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcaaaagacgttaaatacacaggtcctg

SEQ ID NO: 27568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcaatgggttttaggcttgctccatcat

SEQ ID NO: 27569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcaccttggtttacgttggtccaattac

SEQ ID NO: 27570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcacgaaagcttaacaattgatatgtac

SEQ ID NO: 27571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcagcagtaatacagtttcttcgggagg

SEQ ID NO: 27572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcagcgagaagagcgactctactggcgc

SEQ ID NO: 27573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcaggtagaggggccgcacacgatacgc

SEQ ID NO: 27574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcaggttttctcgattggcaatgtgggc

SEQ ID NO: 27575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcataagtcacggccatgccgcgctcac

SEQ ID NO: 27576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcatgacgttaacctgtgatggctgggc

SEQ ID NO: 27577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcattccagatcttagtgccgttctctc

SEQ ID NO: 27578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgccatgtcccatgcgagcccttccttcg

SEQ ID NO: 27579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgccccaagactttcggcaatccgtctgc

SEQ ID NO: 27580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgccgacgtgtaccaaggcacgtttacct

SEQ ID NO: 27581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgccgctatgtctgtcccatggctttacc

SEQ ID NO: 27582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgccggacattgacgcacgggactctggg

SEQ ID NO: 27583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcctcgcaaaccctatgagcgcatgcgg

SEQ ID NO: 27584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgccttgtcgacgcggcctctgccggacg

SEQ ID NO: 27585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcgaagtgggcattgcaatcatcgtcaa

SEQ ID NO: 27586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcgactcgcaataaggtatggtgttcac

SEQ ID NO: 27587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcgcaggaagggagctaatcccggtctg

SEQ ID NO: 27588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcgcatctcgtattggattagctgagcc

SEQ ID NO: 27589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcggagtcgttcacggatgggaacacgt

SEQ ID NO: 27590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcggcattggggccgaaatggtgttatc

SEQ ID NO: 27591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcggcgaagtcagaggatagacgagtgc

SEQ ID NO: 27592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcgggccgtgacgagtggtgacggactg

SEQ ID NO: 27593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcggtatgacgttctccctatccagcac

SEQ ID NO: 27594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcggtggaaggacctgtgctatggttgt

SEQ ID NO: 27595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcgtggtcggtggggaccgccatttctg

SEQ ID NO: 27596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgctacatttgctctggcttggcggatta

SEQ ID NO: 27597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgctcaaatgcacatggtcttaggtgtca

SEQ ID NO: 27598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgctggaggctggcctttcggcttgggat

SEQ ID NO: 27599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgctgtggaaattgtaggtcgatagaggg

SEQ ID NO: 27600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgcttgcttacttcggtttggccttggat

SEQ ID NO: 27601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggacagctgagcgaattcctttatgtgg

SEQ ID NO: 27602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggaccgatgtaccgttctgtgctttgta

SEQ ID NO: 27603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggacgtccgctggcaccctagtttcgga

SEQ ID NO: 27604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggagtagccattctgcggcctacggtgg

SEQ ID NO: 27605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggatacttcgttctgacttcatgtgtcc

SEQ ID NO: 27606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggatcttggcacgcaagtatgttaaggg

SEQ ID NO: 27607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggcaagaacaactccagtcggctgactt

SEQ ID NO: 27608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggcatctccgctgttcgggcatctttag

SEQ ID NO: 27609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggccctgcatctctaatttcggcggctc

SEQ ID NO: 27610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggccgttcacctactaggtgtcattgcg

SEQ ID NO: 27611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggcctaagttgtttgaggttcgggttct

SEQ ID NO: 27612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggcctacaattatggggagctaccgcgt

SEQ ID NO: 27613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggctcccaaataccgtactattacgggc

SEQ ID NO: 27614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggctctcctcggtcttcccggtgtagca

SEQ ID NO: 27615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgggccaggagcgttgtagggcctggtaa

SEQ ID NO: 27616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgggcgataactgcgcgtctgcacctcgt

SEQ ID NO: 27617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggggaggtggcggctccataccagtggt

SEQ ID NO: 27618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggggctagagcctgttgtgcgaccttgg

SEQ ID NO: 27619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgggggacattctggggccggcccgggtc

SEQ ID NO: 27620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggggggttgctggtagtctgtaggcccc

SEQ ID NO: 27621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgggttttattactttgtatcctttagaa

SEQ ID NO: 27622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggtcataccgcgactcacgtcacgggtt

SEQ ID NO: 27623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggtctggttcacgtacctgtactactgc

SEQ ID NO: 27624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggtgaccacgtgcccagcagctccaggt

SEQ ID NO: 27625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggtgagcaagatgtgccgttccccagtc

SEQ ID NO: 27626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggtgtccagtcggcttacgaagcttttc

SEQ ID NO: 27627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccggtttcttgcggggggaagtcgaatttg

SEQ ID NO: 27628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtaaagtcgggaaggattgccctatatg

SEQ ID NO: 27629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtaactggctcgccatgcgatcatgcta

SEQ ID NO: 27630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtaacttcagaaacagtgctccagctat

SEQ ID NO: 27631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtaaggctgcgcataccaatgtcctaca

SEQ ID NO: 27632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtacatcggggagtatacagtgtaggtt

SEQ ID NO: 27633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtatcatagttctttggcctgtagagtc

SEQ ID NO: 27634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtatgaagatagtattcaataattatct

SEQ ID NO: 27635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtatgcgcttgccccataggatcgtctc

SEQ ID NO: 27636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtatggacttgtgcagccccggacctcc

SEQ ID NO: 27637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtattttatgtctgttagccccgggatc

SEQ ID NO: 27638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtcaagtaagtctgtgaaatttaaacgc

SEQ ID NO: 27639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtcagacgaaccatgtttacagagctaa

SEQ ID NO: 27640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtcctcctacgcctcctacgcatatcga

SEQ ID NO: 27641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtcgcagttgcactgccggttcccgctt

SEQ ID NO: 27642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtcggagctgggtgccaaaggcccagcg

SEQ ID NO: 27643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtctatcccttcctctcgtttaaactga

SEQ ID NO: 27644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtctcgccagttggaatggaagggaagg

SEQ ID NO: 27645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtcttatttgggctggtttaagtgcaac

SEQ ID NO: 27646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtctttggtggctcgatcctcaggcatg

SEQ ID NO: 27647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtgaggaaatcgcccatcccggtgtggg

SEQ ID NO: 27648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtgataggctggcgtacgtaccggtcct

SEQ ID NO: 27649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtgatggacgcaaactgatcgctcgttt

SEQ ID NO: 27650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtgcaggtgggattggcagtccaacttg

SEQ ID NO: 27651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtgcatgagcctgggacatgggggggca

SEQ ID NO: 27652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtgccagatttccgtatgaccgagtaag

SEQ ID NO: 27653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtgcgagagacagctgtgttttaggtat

SEQ ID NO: 27654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtgctccgtatcctatgacacaagccga

SEQ ID NO: 27655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtggggacagccaagatcctggcgtatc

SEQ ID NO: 27656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtggtcagcctagcggatgtaattacga

SEQ ID NO: 27657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtggtctccgaggctcgaaatacgtatc

SEQ ID NO: 27658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtgtactgccaggctttgatcctagagg

SEQ ID NO: 27659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtgtataaaggggagagcaacatactcg

SEQ ID NO: 27660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtgtcgtgtagtgcaggaccttcatcgg

SEQ ID NO: 27661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtgtttgtgctggttcgtgggtaacgcc

SEQ ID NO: 27662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgttaaaagggttgacgtttccgttaccc

SEQ ID NO: 27663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgttcaagcctatctatgtaagtctgacg

SEQ ID NO: 27664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgttcggtgatgagtatcgagggcacgcg

SEQ ID NO: 27665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtttcgacgtgtcagtagccatgctggt

SEQ ID NO: 27666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccgtttgtgcgtgccagtcttgttggggtc

SEQ ID NO: 27667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctaaaactattcctcttctttctaatgtt

SEQ ID NO: 27668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctaagggacgaggtggtggtacatggata

SEQ ID NO: 27669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctaagtacctccaatgacatcctatttta

SEQ ID NO: 27670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctacatcttggagactgcagggccggtgc

SEQ ID NO: 27671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctacctgacggcccgcacggtctgattcc

SEQ ID NO: 27672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctacgtccaggagatcgggaagtggaatg

SEQ ID NO: 27673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctacgttcgtgacactgattcgtttacgt

SEQ ID NO: 27674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctactagcttcctccagtttggcgggacg

SEQ ID NO: 27675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctacttacgcatgatgacgaaactttcga

SEQ ID NO: 27676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctacttgataccatttgactttagcgtgt

SEQ ID NO: 27677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctagcaaagccatggggtccaagagcacg

SEQ ID NO: 27678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctagcagatcggacggctgttgcacgcat

SEQ ID NO: 27679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctagctgtaggcccagcatagaatcagca

SEQ ID NO: 27680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctagtaattagatgcttggtacaccgagg

SEQ ID NO: 27681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctataggtctggctctcctcgtgccgtac

SEQ ID NO: 27682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctatcaagtaagataagttgtagtgctgt

SEQ ID NO: 27683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctatccgtaaatgcagtacacgccttaac

SEQ ID NO: 27684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctatctgcatgtattcgaagtgttatagc

SEQ ID NO: 27685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctatgcaatccgcccgccgtgccccaacg

SEQ ID NO: 27686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctattatcgcagtcggaatctatgttgct

SEQ ID NO: 27687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctcaaccgttggtacatgcagtgattggg

SEQ ID NO: 27688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctcacacctctcgactcgacccacggctt

SEQ ID NO: 27689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctcagcgtgcgtgagaatattgttgaggc

SEQ ID NO: 27690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctcagttaacaaggggatctagtgccagg

SEQ ID NO: 27691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctcagtttcccggaacactggacccccga

SEQ ID NO: 27692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctccaggctcttcggttaatgatttatcg

SEQ ID NO: 27693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctcccaacacttcctaacctgtgccgttc

SEQ ID NO: 27694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctcctagacaagtctatcatgtgttacgg

SEQ ID NO: 27695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctcctcgcgtacgctgttttattctagct

SEQ ID NO: 27696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctcctttgtgtactgttctatggttttag

SEQ ID NO: 27697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctcctttttgctcaccccttgccagttcg

SEQ ID NO: 27698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctcgagactttgccgacggtcccgcagtt

SEQ ID NO: 27699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctcggactcgcgagtaaatcgacttaccg

SEQ ID NO: 27700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctcggttacggccaatttggctgtgcggc

SEQ ID NO: 27701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctcgtggagtcatctctacaggtaaagtc

SEQ ID NO: 27702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctctcaatatgtgagcgttggcgagcgtt

SEQ ID NO: 27703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctctgtccatctcaagtcagcggacgtga

SEQ ID NO: 27704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctctgtcctcggggaagacgcttggtccg

SEQ ID NO: 27705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctctgtcgctcgggcactcgatctgtctg

SEQ ID NO: 27706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctcttgaatagtttgtgtagtcaagattc

SEQ ID NO: 27707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctcttgatctcatacatttcctccttatg

SEQ ID NO: 27708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctcttgtggtacagcagttatcgcgcgtc

SEQ ID NO: 27709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctctttccgtgtgctttatgatggcgccg

SEQ ID NO: 27710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctctttgcaaggggcttctcccttcgcgt

SEQ ID NO: 27711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctcttttggggcagtgtagttgactttgt

SEQ ID NO: 27712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgaacatatggatgtgaaaagcccgaag

SEQ ID NO: 27713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgaatgctacactctatcggtctgaggg

SEQ ID NO: 27714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgacaccttgggcaacaatcggtacgcg

SEQ ID NO: 27715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgaccacggcatatgagaagatggccct

SEQ ID NO: 27716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgactccgggtctcatcgcctgggtctg

SEQ ID NO: 27717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgactctgcttccaatcccaacgtcacc

SEQ ID NO: 27718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgactctgcttcttccgtcgttttggtc

SEQ ID NO: 27719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgagcatgattagcccaaatagctatgt

SEQ ID NO: 27720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgagtaccgatcggagcaacgcgcagaa

SEQ ID NO: 27721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgatagagttttcgtgggtacctgcaca

SEQ ID NO: 27722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgatgacctgcacgggcccgcaggtgcg

SEQ ID NO: 27723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgattgcgtataaaagttacgtgatatc

SEQ ID NO: 27724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgcaaacgtagtttcgtcccgcgcgatt

SEQ ID NO: 27725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgcaatgtaagcgcggcgagcggggagg

SEQ ID NO: 27726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgccagcaagcggaactgaccgcgtatc

SEQ ID NO: 27727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgccgaccttctcttccggtgggcgggg

SEQ ID NO: 27728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgcgattctgctctcccgggtctgaccc

SEQ ID NO: 27729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgcgtacggtagtgcagcggtcagtcgc

SEQ ID NO: 27730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgctgcttgggagttgtgaggacagtga

SEQ ID NO: 27731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgcttggcaaccgtacctggctcactta

SEQ ID NO: 27732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctggacttcgctagtgtcttctcgtgacg

SEQ ID NO: 27733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctggagacgtactagcggacgactcgata

SEQ ID NO: 27734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctggattgaggaaatggactagacgatcg

SEQ ID NO: 27735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctggcagacggttcagtattacaccagcc

SEQ ID NO: 27736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctggcatgcaacggtcttccttgtgcgca

SEQ ID NO: 27737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctggccacgaccggtggaaaagcaacgat

SEQ ID NO: 27738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgggccgcactggtaccggacatactca

SEQ ID NO: 27739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctggggtaccttaccaagtcagacgggca

SEQ ID NO: 27740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgggtgaggcaagcggcaggcagtagtt

SEQ ID NO: 27741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgggttttggaatgtatctttacagtgc

SEQ ID NO: 27742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctggtcaccctgacgctatctacaccccc

SEQ ID NO: 27743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctggttgcttacaagacggacccgctatg

SEQ ID NO: 27744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgtactttcgatttgttctaattgaatg

SEQ ID NO: 27745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgtattaacgccttacgcagcgccgccg

SEQ ID NO: 27746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgtattgggcattttagttgcgggacac

SEQ ID NO: 27747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgtcccagaggtagcgcactgcctgttg

SEQ ID NO: 27748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgtcgcagggatcactggaggcttatcc

SEQ ID NO: 27749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgtctactcttgagttcgctactgttcg

SEQ ID NO: 27750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgtgggcaacgtgctacgcatttcatgt

SEQ ID NO: 27751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgttgctggttttcgccccggtgtctgt

SEQ ID NO: 27752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctgtttagggtccgatgcggacaggtacg

SEQ ID NO: 27753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccttacatcttctacttacgtcttctgggc

SEQ ID NO: 27754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccttacttctcatcagccaagtctatgctt

SEQ ID NO: 27755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccttaggaacctacggtgcgccgggggtgc

SEQ ID NO: 27756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccttatttaatcatttaggcgtatttaggc

SEQ ID NO: 27757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccttcatattcgttatatactcccaagtct

SEQ ID NO: 27758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccttcgattctcggatccgttatgcatcgc

SEQ ID NO: 27759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccttcgtgttgggtgactccacctgcctgt

SEQ ID NO: 27760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccttcttgcggccattttcgtggtgactac

SEQ ID NO: 27761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccttgaccaacgtgatatctctcgcgagcg

SEQ ID NO: 27762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccttgagcagctgtgtatatcgtaacgtag

SEQ ID NO: 27763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccttgagccttcctgcggattgccccgttg

SEQ ID NO: 27764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccttgcgtgcactgacccaaatagtcgcgg

SEQ ID NO: 27765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccttgctctcatggcaagcatcaaccgccg

SEQ ID NO: 27766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccttggaaccatacacagtttagctgcgtc

SEQ ID NO: 27767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccttggtgtggtactacctggtcgggattg

SEQ ID NO: 27768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccttggttaagcttcatcgcatatgaattg

SEQ ID NO: 27769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctttaacattaagaaccaatcgcctttca

SEQ ID NO: 27770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctttcggacgagtatccagctggtgcgat

SEQ ID NO: 27771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctttcggtatctcaatcccccagttaagt

SEQ ID NO: 27772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcctttgtcctgctgtaattcatgccggtgt

SEQ ID NO: 27773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgccttttcctcgactgcttcaccctgacttg

SEQ ID NO: 27774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaaaacaacgactcatcctaaacctctgg

SEQ ID NO: 27775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaaacccacatcggagtccacatccagta

SEQ ID NO: 27776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaaactggtccacaccaaggccagccact

SEQ ID NO: 27777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaaagatcccacgccttacgacgagttca

SEQ ID NO: 27778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaaaggctgaatgccatgtcgtcccagat

SEQ ID NO: 27779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaaagtcatccggttcatgtcctcgctgc

SEQ ID NO: 27780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaacaagtgagtttgatattgcaccttgg

SEQ ID NO: 27781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaacatatgactgacccggttccgaagag

SEQ ID NO: 27782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaacatccttaccatcgattgttgagacc

SEQ ID NO: 27783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaaccgctcaccgctgccttacggtctcc

SEQ ID NO: 27784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaaccggcctcctggtagtccatagcctt

SEQ ID NO: 27785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaacgatatccacgtggttaagtcccgca

SEQ ID NO: 27786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaacggccaatgtctggagtgttttcgcg

SEQ ID NO: 27787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaacgggaaccacatcagcgttactttgc

SEQ ID NO: 27788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaacggggatatactggccgaacatccga

SEQ ID NO: 27789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaagagagtagctatcgggtctctgtacg

SEQ ID NO: 27790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaagattttcaattaattataggctcgta

SEQ ID NO: 27791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaagcagtaccttgcctattgagggcttt

SEQ ID NO: 27792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaagcggcgttacttccgttcgggtttga

SEQ ID NO: 27793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaaggacggcaaattcacaacggttgtcc

SEQ ID NO: 27794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaaggacggctgtggcacacacaacggcc

SEQ ID NO: 27795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaagggtgttctagttcaatgtcatcttg

SEQ ID NO: 27796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaaggtagtgcgcgtcttccatgggttaa

SEQ ID NO: 27797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaaggtcggattcccctatatcatgcgtt

SEQ ID NO: 27798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaagtacagtcacgtccggaggctaggcg

SEQ ID NO: 27799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaagtccggacctttgcactccccggtac

SEQ ID NO: 27800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaagtggcctccattcatgtcccttgtca

SEQ ID NO: 27801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaataagcatctggacatgtacgcccgtt

SEQ ID NO: 27802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaataggagagctatcacacgtcctgtgt

SEQ ID NO: 27803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaatcgacaacgcgtgccgtatcgctggg

SEQ ID NO: 27804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaatcgctacccaacatcagtttgcgttt

SEQ ID NO: 27805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaatcttcatggtcgacgttaagcactgc

SEQ ID NO: 27806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaattctcggcgtaagtgggtgccgtcgc

SEQ ID NO: 27807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacaaggaagaacgggtccgccgtaacga

SEQ ID NO: 27808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacaagttaagataaattctcccgcgaca

SEQ ID NO: 27809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacaatacgtctacccgggtgtaggtagg

SEQ ID NO: 27810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacacaaaccgcagagtccttcttggcga

SEQ ID NO: 27811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacacaaccgtcgaatcctttatgcgtgt

SEQ ID NO: 27812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacacactcgtgatcagaccgactgcgag

SEQ ID NO: 27813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacacatagtagcaacggtacaccagtgc

SEQ ID NO: 27814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacaccgcacaaccgttacggacgttggc

SEQ ID NO: 27815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacacgataacagagagggtcaccgtggg

SEQ ID NO: 27816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacactgtgattgtaacttagctggtctg

SEQ ID NO: 27817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacaggaaggaggggttgttagttgacac

SEQ ID NO: 27818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacaggcggaggcgctgcatcgtccgtaa

SEQ ID NO: 27819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacagggcgatcatatcgggcaggattcg

SEQ ID NO: 27820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacagtccgtatacatcgggtccttagcg

SEQ ID NO: 27821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacatatcaatcggatgtttggagggtgg

SEQ ID NO: 27822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacatgtgcctccccttgtgctgcgtaac

SEQ ID NO: 27823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaccagaccgttgagaggcttcgagcgct

SEQ ID NO: 27824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaccagcagaactcatctggtattgcgtg

SEQ ID NO: 27825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaccataattgggccggtcctcttgtggg

SEQ ID NO: 27826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaccatggcatctttctgcggagtttcgg

SEQ ID NO: 27827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacccaccgtttcgatattagggaccccc

SEQ ID NO: 27828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacccactttcacaaattaccgaatcata

SEQ ID NO: 27829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacccgattaggattgcgtttgcgtgttg

SEQ ID NO: 27830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacccggtttagttgtgatcgtccggccg

SEQ ID NO: 27831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaccctgtggtccgatacgtcatagactt

SEQ ID NO: 27832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaccgagaccatatacgattacacaattg

SEQ ID NO: 27833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaccgagagtttctggggtcacgctcggg

SEQ ID NO: 27834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaccgggtatcgtgcacgtctccgctcgg

SEQ ID NO: 27835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacctcatggctgtcctgataacgagctg

SEQ ID NO: 27836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacctcctgttttacccgccgctcacagg

SEQ ID NO: 27837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacctcgccacggccgcagccaaatcgat

SEQ ID NO: 27838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaccttgtctatcataagcaattacactg

SEQ ID NO: 27839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacgaggtgcggtgactccatcgcgttat

SEQ ID NO: 27840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacgattttgaaaacgaccgggtcagatc

SEQ ID NO: 27841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacgctcgtttcgattatacgaacgggac

SEQ ID NO: 27842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacggcgtgcacctgatgtggagctagcc

SEQ ID NO: 27843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacggtggggtatacgtgtacagctaccg

SEQ ID NO: 27844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacgtaatgtaagtagaagacgagttttg

SEQ ID NO: 27845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacgtagtagataggcagctccgcgtgtg

SEQ ID NO: 27846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacgtcttttctatacttgcgatagtgag

SEQ ID NO: 27847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacgtgctcctacattcattagaggatgg

SEQ ID NO: 27848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacgtttacaacctgccttagggtagact

SEQ ID NO: 27849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgactaacgtgagggcggaacagatttacg

SEQ ID NO: 27850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgactatgcccacgggaagtgtgggtcact

SEQ ID NO: 27851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgactatttttcacgccctggtctgcggga

SEQ ID NO: 27852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgactcctggaatctggttggggtcattgt

SEQ ID NO: 27853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgactctaatttcttttccggccgttacgg

SEQ ID NO: 27854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgactgaggagagtctagggccttgatgac

SEQ ID NO: 27855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgacttggtgctcataacagttaacgcgcg

SEQ ID NO: 27856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagaacggaaaccagttattttattaagg

SEQ ID NO: 27857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagacaggcatagttgtgctgcataccac

SEQ ID NO: 27858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagactgatggaacaactgaaaattggag

SEQ ID NO: 27859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagagctacggacatgacatacgctgctg

SEQ ID NO: 27860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagaggcaccggaatgataggctgttatc

SEQ ID NO: 27861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagaggctggtagtggcttgtgcgtgtgc

SEQ ID NO: 27862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagaggtaacatatctgttatacatcgta

SEQ ID NO: 27863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagcaggtaccggtgaagagtcccggttc

SEQ ID NO: 27864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagcattccggcgtattccttcaaccggg

SEQ ID NO: 27865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagcgaactagactctgatagtggcggga

SEQ ID NO: 27866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagcggaatgtactcgggaatagactcac

SEQ ID NO: 27867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagctggacctttcgttactcgtcggtcg

SEQ ID NO: 27868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaggacgaggcgtaggttggtgttgcacg

SEQ ID NO: 27869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaggagaacgaacataagggtgtcggcgg

SEQ ID NO: 27870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaggattactcttccaaacgggcttattg

SEQ ID NO: 27871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaggcagaggttaatggaaagcacccgac

SEQ ID NO: 27872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaggcttggaacagctttatgccaattcg

SEQ ID NO: 27873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagggccaacctctggagctacgcatggc

SEQ ID NO: 27874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagggctactgttcggaaagcaggacgtt

SEQ ID NO: 27875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagggggaatagggtttccgtgtgtgtgt

SEQ ID NO: 27876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgaggggttgacgcaggtgaagcggaagtg

SEQ ID NO: 27877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagtaagttcgtggatgtgtcacgtcctc

SEQ ID NO: 27878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagtaggcatcggctgcatagcagttagg

SEQ ID NO: 27879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagtagtcgacatcggtccctttctatac

SEQ ID NO: 27880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagtagtctcgctatcccatttgaacccc

SEQ ID NO: 27881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagtctaacaaacctgtgacaacctccgt

SEQ ID NO: 27882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgagtgccctcggggtaggagaatagggat

SEQ ID NO: 27883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgatacggcctggtcataactcgtgtttcc

SEQ ID NO: 27884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgatagcgtgacatatgtcgactttggatt

SEQ ID NO: 27885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgatcacaccctggagggatcggtgctccg

SEQ ID NO: 27886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgatcaggacactccccgattgataggttc

SEQ ID NO: 27887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgatccgtcttagtttatggcagagatgtt

SEQ ID NO: 27888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgatcgatgcactgtaaacagctggcgtca

SEQ ID NO: 27889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgatcgggaagagcacaacctacggtgcac

SEQ ID NO: 27890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgatgaaggatacgatcgttgccagagtaa

SEQ ID NO: 27891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgatgagctggcaggggaaacactaggttc

SEQ ID NO: 27892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgatgctttgggtaaggttcaccgtttgtg

SEQ ID NO: 27893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgatggcagcttcagtgtcgtctgtgttgg

SEQ ID NO: 27894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgatggtatggacgaggaaacctgaccgtc

SEQ ID NO: 27895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgatggtctggcacatagtacacagactga

SEQ ID NO: 27896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgatgtgtgacccacgcctgtttatcccgc

SEQ ID NO: 27897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgatgttaggaggatgcgttaggtcgccgg

SEQ ID NO: 27898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgattaaatgccttctgacggccggcggta

SEQ ID NO: 27899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgattaacctgcgttcctagactgtccctc

SEQ ID NO: 27900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgattagagcgaaaagtattgaaaccttag

SEQ ID NO: 27901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgattagcaagtcctcattaactggcacac

SEQ ID NO: 27902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgattccaccccgcacgtgtaatctacatt

SEQ ID NO: 27903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgattctggttgcaccagttacgtgtcgca

SEQ ID NO: 27904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgatttatcactggttacaacgctagcatc

SEQ ID NO: 27905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcaaagagcaggggcggtcacggcaagat

SEQ ID NO: 27906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcaaagccaagctatcctttgtgttattg

SEQ ID NO: 27907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcaaagtcccggtacggttgcgaggtaca

SEQ ID NO: 27908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcaaagtgctttaggtttcggcccctcgt

SEQ ID NO: 27909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcaacctacaagagtcttgtcgcagctag

SEQ ID NO: 27910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcaacgagatcgtcaaacccccggctttt

SEQ ID NO: 27911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcaacggactagtggtgccgctttggcga

SEQ ID NO: 27912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcaagagcttcctcggttcgatgaacgct

SEQ ID NO: 27913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcaagccttattatagccgagcggagttg

SEQ ID NO: 27914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcaagcttaaactcgattgttctttttgc

SEQ ID NO: 27915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcaagggctacaatgatttcgtcaatggg

SEQ ID NO: 27916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcaagttgtacgtgcgagcgatctggtcc

SEQ ID NO: 27917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcaatgccgtgtgatcatctgggcgggaa

SEQ ID NO: 27918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcacaactgctacacctggaccgggttct

SEQ ID NO: 27919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcacaccttttttgtcaggcaaccggcgt

SEQ ID NO: 27920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcaccagagaccggggaatgtaaggttag

SEQ ID NO: 27921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcacgaacagcgagcatttcctcggcacc

SEQ ID NO: 27922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcacgacaaacaacgattcgggcttgagt

SEQ ID NO: 27923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcacggggctcacgaataccggggacttg

SEQ ID NO: 27924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcacgggtctagtgcaagtgtgtgttctc

SEQ ID NO: 27925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcactctttcaaacggagggttgtccttc

SEQ ID NO: 27926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcactgggtgatccggccagggttgaggt

SEQ ID NO: 27927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcagaagcaggttgcacagcggtcttgta

SEQ ID NO: 27928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcagactgccatgaacgagccgtggtgtg

SEQ ID NO: 27929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcagagggggtgtttcaagtatacctttc

SEQ ID NO: 27930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcagaggtcccacaatagggtaattgtac

SEQ ID NO: 27931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcagatagcacgtcccgtgtggactgagg

SEQ ID NO: 27932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcagcaaggtcatgccatcctcgtgtttc

SEQ ID NO: 27933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcagcaataccgacagattgtgtcctcac

SEQ ID NO: 27934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcagcatcaaactacctgtgtgtatgggc

SEQ ID NO: 27935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcagctgacatggtacgcgtgagttaggg

SEQ ID NO: 27936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcaggattatgttggctctttttaggcgg

SEQ ID NO: 27937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcaggcttaggtctcctgtgattggtgcg

SEQ ID NO: 27938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcagtatatatggtttggtctagccccgg

SEQ ID NO: 27939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcagtgcggactccggttgaggtgtggcc

SEQ ID NO: 27940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcagttaaacagtactaataagctttgcg

SEQ ID NO: 27941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcatagtccattacctcagcaagagcgag

SEQ ID NO: 27942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcatcacaaagccgtttttcgtgatcggc

SEQ ID NO: 27943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcatcccccgccgacagctcctcgttctt

SEQ ID NO: 27944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcatcctttgttcctttattggttccggg

SEQ ID NO: 27945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcatcgattgtttgggtggggaatctgca

SEQ ID NO: 27946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcatcggttatttatcggtggtgatcgtg

SEQ ID NO: 27947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcatctccttgaattttgcacctggatac

SEQ ID NO: 27948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcatcttcaaattgggggtgtcttggttt

SEQ ID NO: 27949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcatgcgtgcggtcctcagtgcgatccgc

SEQ ID NO: 27950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcattgactgtacgtaaagcctgcagtcc

SEQ ID NO: 27951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcattgagctctgtggcagtccgttccgg

SEQ ID NO: 27952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgccaaccgaagtttcacatgtacagcaga

SEQ ID NO: 27953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgccaagttagaggggtttttcctctatcc

SEQ ID NO: 27954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgccaatcaatattttttgcttgcgtccct

SEQ ID NO: 27955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgccaccaagttcttgtcgactagggcgaa

SEQ ID NO: 27956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgccactagactgactactggtgtacgcgt

SEQ ID NO: 27957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgccagcatcgtcctctccgagtgccttta

SEQ ID NO: 27958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgccatgggttacgccttggcacaatgaac

SEQ ID NO: 27959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcccacggaacgtcccggcacaaggcgat

SEQ ID NO: 27960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgccccaaaagcggaggtcgtcaaacaagg

SEQ ID NO: 27961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcccccacgcacaactggctttaatgcgg

SEQ ID NO: 27962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcccggtaaatggtaagtccccgttgtgc

SEQ ID NO: 27963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcccggtggtgcatccctgagttgaagtg

SEQ ID NO: 27964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcccggtgtattatatatcgacagaaagc

SEQ ID NO: 27965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcccgtttagtatctcacatacttagctc

SEQ ID NO: 27966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgccctctcaatttcagataacgtatgcaa

SEQ ID NO: 27967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgccgaattagccttacgggtctcggttcc

SEQ ID NO: 27968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgccgcaaagggtgagcgacggcgaaaaga

SEQ ID NO: 27969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgccgtcgactgataccgttctctagactt

SEQ ID NO: 27970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgccgtgggttatcatcatgtcattcggtg

SEQ ID NO: 27971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcctaaagtggtaatgtcgtcaagaccgc

SEQ ID NO: 27972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcctcgggttgtcctcgcacaagtaagcc

SEQ ID NO: 27973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcctctatatataggccccgtcgtgcaca

SEQ ID NO: 27974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcctgacggttccttacctacgtcgtccg

SEQ ID NO: 27975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcctgtaccgcaccactaccatctacttc

SEQ ID NO: 27976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgccttacatccttgagcttacgctgggct

SEQ ID NO: 27977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgaaccaagtggattgtgggcaggatgg

SEQ ID NO: 27978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgaacccgtggactgtctgcgtggacat

SEQ ID NO: 27979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgaagcctcaagttcaagagttggtgtg

SEQ ID NO: 27980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgaatttcaggacgggatgttttgcata

SEQ ID NO: 27981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgacccaacctcaagacggggctgggac

SEQ ID NO: 27982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgacggctccctggtatgtgtaaagagc

SEQ ID NO: 27983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgacgtcgctagtcaactgtcagttttt

SEQ ID NO: 27984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgactaaaaattgcatgccttatacagg

SEQ ID NO: 27985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgactggaatctctggatgggttaccta

SEQ ID NO: 27986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgactgtgacaaaaccttgatggctggc

SEQ ID NO: 27987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgagcatcgcaagtacacatagttgcta

SEQ ID NO: 27988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgagcggttggacgtaatgtcccgggcc

SEQ ID NO: 27989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgaggatgcacggccggttcggtgaaaa

SEQ ID NO: 27990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgagtagtctggttgggtatcccattgt

SEQ ID NO: 27991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgagtgaatttcgattatgagtatgtgg

SEQ ID NO: 27992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgatattgccagtgcgagcaaccgtgag

SEQ ID NO: 27993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgatgcaaggcagtttgggtcttaggcg

SEQ ID NO: 27994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgatgcgtattgggttttttcatgacgt

SEQ ID NO: 27995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgcaagctgtggtgtcacattctcgcca

SEQ ID NO: 27996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgcagtctctagtcgtctctaggtcgcg

SEQ ID NO: 27997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgcggaataactctcagggtatactcga

SEQ ID NO: 27998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgctcggtctagccggacggtgtcgacg

SEQ ID NO: 27999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgctctaggctctgtaccttgatttccc

SEQ ID NO: 28000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgcttagtcaacgtagcaccagtttcct

SEQ ID NO: 28001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcggaaggggccttcgcagtgcgtgaggt

SEQ ID NO: 28002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcggaaggtttcgagctgtttgcccgtac

SEQ ID NO: 28003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcggacatacaaagagaggcagtataagg

SEQ ID NO: 28004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcggacccactgggcattcgattagcgtg

SEQ ID NO: 28005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcggagaacaatgctgcacaaccgctgtg

SEQ ID NO: 28006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcggagaggaagacttacagcagcgtagt

SEQ ID NO: 28007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcggaggaggggggatccggtttgctgcg

SEQ ID NO: 28008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcggatatacggcttgctcgtacagttca

SEQ ID NO: 28009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcggcagttttgtattcttattgctttgc

SEQ ID NO: 28010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgggtatgcgacgtggagatcgattctg

SEQ ID NO: 28011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgggtatggctgttgagttaccgtttgc

SEQ ID NO: 28012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgggtcacctcaatcacgggtgttgacc

SEQ ID NO: 28013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcggtcgactgcggatgcttgtatggcgc

SEQ ID NO: 28014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcggttaaggacgaaccattagcgtgctt

SEQ ID NO: 28015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcggttcctctgtagggattcgtgggcga

SEQ ID NO: 28016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgtaaaggcaagcacttttcggccagct

SEQ ID NO: 28017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgtacttgaactctacattgcgatcacc

SEQ ID NO: 28018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgtcagcgtaacatgcgccggtcagcct

SEQ ID NO: 28019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgtccaagttctagggggacagatcgtc

SEQ ID NO: 28020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgtcgttacgtatcagtttggctaagcc

SEQ ID NO: 28021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgtctatgttcattggaagcgcttggtg

SEQ ID NO: 28022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgtgtcttgcttcgcctgaactatgggt

SEQ ID NO: 28023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgtgttgggacaaaattcgtgacacgct

SEQ ID NO: 28024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgttagttcgaatgtgttcgcgtccaaa

SEQ ID NO: 28025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgtttccttattcctttgttaccccagc

SEQ ID NO: 28026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcgttttcggaggactgtgcaattatcgc

SEQ ID NO: 28027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctaaacaacggtgtgctatcttgcaggc

SEQ ID NO: 28028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctaacaacaccgagcagcgcccttttgt

SEQ ID NO: 28029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctaatgcggatttgacgtagtaagcaag

SEQ ID NO: 28030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctacaacgcaatctttatcttcgcggat

SEQ ID NO: 28031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctacggccaaccagctatacgaggctgc

SEQ ID NO: 28032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctagaggccctgtgatgacctgagtacc

SEQ ID NO: 28033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctagcgtaaattcgtacggctggaagtt

SEQ ID NO: 28034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctatgctctttctgaatccggcgaggca

SEQ ID NO: 28035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctatgtgttgaataccgtcgttaagtat

SEQ ID NO: 28036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctattccggggtggctaacgacttctcg

SEQ ID NO: 28037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctcacaatctcccctcgttgatagtgga

SEQ ID NO: 28038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctcatactcagcaatttcttcgcccgat

SEQ ID NO: 28039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctcccacgtttcgttttattagagttaa

SEQ ID NO: 28040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctcggttggggatagccgtcacggactt

SEQ ID NO: 28041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctctgcagttggttagaccgaatcgctt

SEQ ID NO: 28042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctctgctgtttgtggccttgaccggtcc

SEQ ID NO: 28043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctgaattggtgttatttccgtgcatagt

SEQ ID NO: 28044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctgagggcatggcgaggatgttgcacgc

SEQ ID NO: 28045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctgaggggagtttgtcctagttgggctg

SEQ ID NO: 28046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctgcagcacatctaccctgcagacaaac

SEQ ID NO: 28047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctggaccatataggcatagcggtagggc

SEQ ID NO: 28048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctgggaacggtctcgatagcccgcgggt

SEQ ID NO: 28049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctgggcatgtgtgttcggtcttcagagc

SEQ ID NO: 28050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctggtaaatgccacggtgtcccggcccc

SEQ ID NO: 28051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctggtcgcatgggtatgtccatgtccga

SEQ ID NO: 28052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctgtatgttagcccgtatcgagccgttt

SEQ ID NO: 28053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctgtcgactctcgctactatgacttgcg

SEQ ID NO: 28054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctgtgagctctgttgttgcacataagcg

SEQ ID NO: 28055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcttaagaccatttacattacctgttgtg

SEQ ID NO: 28056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcttaggtttctacggggcagagtctgat

SEQ ID NO: 28057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcttatccttagtaggtcgacatatggcg

SEQ ID NO: 28058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcttatggcttggttagaacctggacccg

SEQ ID NO: 28059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcttatggttcttcgtgttttcccggtac

SEQ ID NO: 28060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcttattggcagtgtcgcgagtatgaacc

SEQ ID NO: 28061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcttcggtctctaaggcgggtagcggtgt

SEQ ID NO: 28062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcttgcagctagaataacgagccacatga

SEQ ID NO: 28063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgcttttagccctgactttggagactggat

SEQ ID NO: 28064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgctttttcgtttttcagcgtgcgtgcgcg

SEQ ID NO: 28065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggaaacacacgccttatggtgccacgatc

SEQ ID NO: 28066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggaaacgggtagacttcaatcatatgggg

SEQ ID NO: 28067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggaacagcggtctgggtcaacgtacatct

SEQ ID NO: 28068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggaacgaggatcgaatggtcactgtggga

SEQ ID NO: 28069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggaacggggtcgacgtgatttttagcctt

SEQ ID NO: 28070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggaagcgtgtgtccagtgctcagccacgc

SEQ ID NO: 28071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggaaggtagctcgttgtaatgcgacgcgc

SEQ ID NO: 28072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggaagtcccttcgtatttgggccgcttca

SEQ ID NO: 28073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggaatactaaaagtcccgatagtttgata

SEQ ID NO: 28074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggaatccgagggataaagggatcgtccga

SEQ ID NO: 28075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggaattaggtcgctacataattgtaactg

SEQ ID NO: 28076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggacaaatattcgcctcatcgctgcgggg

SEQ ID NO: 28077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggacacacagttatgtcactttcccactc

SEQ ID NO: 28078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggacataaccgtctcactggtacccggtc

SEQ ID NO: 28079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggaccttaaatcatttcttgattaatccg

SEQ ID NO: 28080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggacgacgagacggaagtatacgtgcgtc

SEQ ID NO: 28081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggacgagcttggctgggtttggactgttg

SEQ ID NO: 28082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggacggtgagtgcgacaaatgccttggtg

SEQ ID NO: 28083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggacgtcgctcagtttagctcatcgcata

SEQ ID NO: 28084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggacgtgcagttgcggtttagtcgaaaat

SEQ ID NO: 28085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggacgtttacccagacggcgattgtatgc

SEQ ID NO: 28086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggactgataggtagtctcccgtcagttgg

SEQ ID NO: 28087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggactggctactaggatcaagcgaccact

SEQ ID NO: 28088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggagagcgaggcgtgggttcagacatctc

SEQ ID NO: 28089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggagcactacatggtgggatgccaagccg

SEQ ID NO: 28090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggaggcttctcgtggggatgtgatagccg

SEQ ID NO: 28091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggagggcaaggcgcctggctgcgttcgga

SEQ ID NO: 28092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggagggggggtacgttgtttcggtacgtg

SEQ ID NO: 28093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggagtgcaccactaactgaccacacgagc

SEQ ID NO: 28094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggagtggtaagacgcggatggctgtgacc

SEQ ID NO: 28095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggataaccaacacttctggactgccgttc

SEQ ID NO: 28096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggatcatttgttttgggtaatggaccgtt

SEQ ID NO: 28097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggatgccaagttcttccacgacgactggc

SEQ ID NO: 28098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggatttcgggttttgtgcgctgtcagggt

SEQ ID NO: 28099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggattttggaagcgacattccggccccaa

SEQ ID NO: 28100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcaacctggggacactgcggaaagtggt

SEQ ID NO: 28101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcaatcgacttttccggatgatgctaca

SEQ ID NO: 28102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcaatcgctttcctattgattgctctcc

SEQ ID NO: 28103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcaatcggatctagttcgcttttaatcc

SEQ ID NO: 28104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcaattaaatggcgaacgctcactcttt

SEQ ID NO: 28105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcacagttcgagttgccccggtacggcg

SEQ ID NO: 28106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcaccatcgacacagtaggcatctcgag

SEQ ID NO: 28107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcagcactccgtagcccagaccgggcac

SEQ ID NO: 28108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcagtgatgtagtgctctgggcaacctg

SEQ ID NO: 28109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcataagatgtctggccgtggagggaac

SEQ ID NO: 28110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcatcaggtaggttttgcgatcgacacc

SEQ ID NO: 28111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcatctttcggccctacccaaagaaggt

SEQ ID NO: 28112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcattcgattagtctcctgtccaggttg

SEQ ID NO: 28113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcctctgcactcctcgcggtattagctc

SEQ ID NO: 28114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggccttgattgcagggtatttctcgcgga

SEQ ID NO: 28115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcgaactgggaacggggcataatcggcg

SEQ ID NO: 28116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcgacactgatccggtggcacgcttcgt

SEQ ID NO: 28117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcgagttcctgctacggttctatgggtg

SEQ ID NO: 28118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcgattcacgtttaggctgagctatgtg

SEQ ID NO: 28119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcgccgttcgcccactcggctgatcgaa

SEQ ID NO: 28120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcgctcgcggtattgcgggttaaccggt

SEQ ID NO: 28121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcggactggatgatatgtgactcggggc

SEQ ID NO: 28122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcggataggcggggtgttacggccggtg

SEQ ID NO: 28123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggctatcgacagatacgcgtcccagccgg

SEQ ID NO: 28124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggctctcgtgtacggataatctgggtcgg

SEQ ID NO: 28125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggctgcagatgcggaattacgaggtgctt

SEQ ID NO: 28126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggctggaggaggggaatgtgaacataggg

SEQ ID NO: 28127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggcttaacgggtgatcaaaatcatggggt

SEQ ID NO: 28128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggaacgtctgatttaatttctctgcaag

SEQ ID NO: 28129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggacagctcagacgggccaaggaggtca

SEQ ID NO: 28130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggaccgttattctccttacgatctgcgt

SEQ ID NO: 28131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggacgatcactatttatgtctctcgttc

SEQ ID NO: 28132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggagcgaggcatgataccgacacggggc

SEQ ID NO: 28133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggaggcactggacacgtttatgatctgg

SEQ ID NO: 28134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggagtctgcgaaaggaccttttgtttgg

SEQ ID NO: 28135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggatagcaccttgagcgttcttacggga

SEQ ID NO: 28136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggatgaggcctcgacgattggttgagcg

SEQ ID NO: 28137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggatgattgtaaaggttacaggagatcc

SEQ ID NO: 28138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggcaaaaagaccttgtgtaaacgcggag

SEQ ID NO: 28139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggcacgatgcgactatttcgcttagttc

SEQ ID NO: 28140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggcatgcacgaattgtggatgttaccca

SEQ ID NO: 28141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggcccgtacatgcgtatgagttccgtgg

SEQ ID NO: 28142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggcctcagcgggcagttgcaccccaagt

SEQ ID NO: 28143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggcgaacacttccgatgacgtggtatcc

SEQ ID NO: 28144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggcgcagtgataccggtcacgttctcgg

SEQ ID NO: 28145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggcgcgatttcgacggtagcagtcattt

SEQ ID NO: 28146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggcgggtacttctggtgcggttcgatgg

SEQ ID NO: 28147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggcgtcggtggtgttttagccatgccgg

SEQ ID NO: 28148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggctgggctgcgaatgcgggctgtctgt

SEQ ID NO: 28149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggctttttggtgggcagtgatggaagta

SEQ ID NO: 28150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggggaatgacgtcgagggcgtgtccggga

SEQ ID NO: 28151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggggacacgttattcccttgatctgcata

SEQ ID NO: 28152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggggagcaggattctgtgtatagatgccc

SEQ ID NO: 28153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggggagccacacgtttaggatgtagtctc

SEQ ID NO: 28154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggggatgaggcggcgggttgtacggtgta

SEQ ID NO: 28155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggggattgcctactcgacggtgcttcgcc

SEQ ID NO: 28156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggggccggtaaacacacaggcgataatgg

SEQ ID NO: 28157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggggcggtggagcagtagaaccatgctcg

SEQ ID NO: 28158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggggcgtgacgggccgacaattgtggtga

SEQ ID NO: 28159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggggaaagggcgcgatgacgttgacaaa

SEQ ID NO: 28160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggggggagcgggtccgtgtttagtacctc

SEQ ID NO: 28161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggggtgtgggctatcgaggctgaatggt

SEQ ID NO: 28162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggggttgggtgtgagactgcagaggcct

SEQ ID NO: 28163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggggtaagcggcaggatgcccgatgtgtc

SEQ ID NO: 28164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggggtaagggggaattcaatcgagacctg

SEQ ID NO: 28165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggtaatttggccagagcggtgcttgacg

SEQ ID NO: 28166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggtacaccgtggtaacctactcacattt

SEQ ID NO: 28167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggtagtttccaggggcgcttgcggcaca

SEQ ID NO: 28168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggtcacttcgagctatcctgtcgagtga

SEQ ID NO: 28169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggtcctggatgtcccctcaccccgtcta

SEQ ID NO: 28170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggtgcgttatctcgttgcggtactcttc

SEQ ID NO: 28171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggtggctcgttctatttcggaggcagtt

SEQ ID NO: 28172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggtgtgggcctgttgcacccagctcgcg

SEQ ID NO: 28173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggtgtttcccggaatgaatcagatgccg

SEQ ID NO: 28174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggttaatttactatagcgactgccgaga

SEQ ID NO: 28175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgggttgacttatccgtgtcctggggtggt

SEQ ID NO: 28176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtacgacgcccgagcacgttgtttttta

SEQ ID NO: 28177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtacgcacggattgcctaaggggccttg

SEQ ID NO: 28178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtagcgggatcccagcggactttcgagg

SEQ ID NO: 28179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtatgcccgaactcaacatataggagca

SEQ ID NO: 28180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtatgttagtgttctctgtccgcatcgt

SEQ ID NO: 28181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtcaatgtacaccccagcgtaggtactc

SEQ ID NO: 28182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtcaccctacaaggactggtggggaaat

SEQ ID NO: 28183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtcagggtaacgatggggtcgaatcggg

SEQ ID NO: 28184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtcccggatatcagaactcacaggcggc

SEQ ID NO: 28185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtcccttcatttgtccacgatcgaggtc

SEQ ID NO: 28186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtcccttgtgttcctatgtcgtatagta

SEQ ID NO: 28187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtcggatggttctagttgcctttaggtt

SEQ ID NO: 28188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtcggcggctaccctaacttctatggct

SEQ ID NO: 28189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtcggctatctggttaccggtggcgatc

SEQ ID NO: 28190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtcggtgtgggggtcaaggtcagaaggc

SEQ ID NO: 28191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtcgttgaaggttgatccctctactccg

SEQ ID NO: 28192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtgcaagggacactgggttacacgggat

SEQ ID NO: 28193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtgccattcgttactttttcagcagtcg

SEQ ID NO: 28194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtgcctgggggcagcaagctcttggcgg

SEQ ID NO: 28195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtggaactgacatcatgcgaccgtacgg

SEQ ID NO: 28196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtggaatgcccgaggccagcggcaaaac

SEQ ID NO: 28197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtggcgattaatccggtacgcccgtgcc

SEQ ID NO: 28198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtgggcagcattcgcggatgccgagcta

SEQ ID NO: 28199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtggttgtggattgtgccaattaggctg

SEQ ID NO: 28200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtgttacctctagctgacccgttccggc

SEQ ID NO: 28201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggttaagttatggttttgtcagctgctct

SEQ ID NO: 28202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggttagcagttcggcgtttcccctgtttg

SEQ ID NO: 28203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggttcttggacgattatgggttggctcgg

SEQ ID NO: 28204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggttgttttgagaaccgccattgagtggt

SEQ ID NO: 28205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggtttggaggtgttttaagctttaagcgt

SEQ ID NO: 28206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggttttagggtgcctttatggatatctgc

SEQ ID NO: 28207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggttttcacaagtgctgcggtgattaggc

SEQ ID NO: 28208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcggttttggtaccggagtgcgggtttctct

SEQ ID NO: 28209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtaaacaggagctgcaacctcgggtggag

SEQ ID NO: 28210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtaaacgggcgggagagttgcgcagggtg

SEQ ID NO: 28211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtaacccctcggtgtcatgctcggtaact

SEQ ID NO: 28212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtaagcctctgcatgcccgtcgctgttct

SEQ ID NO: 28213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtaaggtcatgtgcaagtcatatactctg

SEQ ID NO: 28214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtaagtggtcgaaaagtgaaacctgggtc

SEQ ID NO: 28215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtacaactcctcatttcatattttggtgt

SEQ ID NO: 28216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtacaagtctgttttcaccgaagcgtgtt

SEQ ID NO: 28217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtacacgttttaagcacatgacatcctaa

SEQ ID NO: 28218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtacactagcagtcggacttcgttaaaat

SEQ ID NO: 28219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtacactataacggtttgcagcgtttgtc

SEQ ID NO: 28220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtacccgtctattttagatatttgcgtag

SEQ ID NO: 28221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtacccgtgaagacgggttgtgggggttg

SEQ ID NO: 28222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtaccgttgtctagctttcccttttatgt

SEQ ID NO: 28223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtacctagacctacaagcgttgaatcgac

SEQ ID NO: 28224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtacggtcgtgtcgggaccgtatgtggat

SEQ ID NO: 28225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtacgttcggcaggcaggtaacgaaaagt

SEQ ID NO: 28226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtactgatattttggattcacattattat

SEQ ID NO: 28227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtagcgcttgggcttttctaccgtctcct

SEQ ID NO: 28228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtaggagaagacatgatcgatctccgacc

SEQ ID NO: 28229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtagggcccacttcgtttatgtgctaaca

SEQ ID NO: 28230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtaggggcattaacacacatcttcgatga

SEQ ID NO: 28231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtagggtggcactcgggtttacttcagtt

SEQ ID NO: 28232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtagttataccgccaaacgggtaaactct

SEQ ID NO: 28233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtatagctccggactaatgtagttggtgt

SEQ ID NO: 28234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtatagttcacgaccttctctcagacgga

SEQ ID NO: 28235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtatcccctccagtaactgcgtagcgggt

SEQ ID NO: 28236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtatcgtagggcgttatgtggaggttggg

SEQ ID NO: 28237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtatctaaccacgcattgttaattatggc

SEQ ID NO: 28238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtatgccgttcgttccatagaccttggat

SEQ ID NO: 28239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtatggtgttaggctgctatttcgcacga

SEQ ID NO: 28240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtattgacaccacgcagagggtggctctg

SEQ ID NO: 28241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcaactttcatggtataagcgctgcgat

SEQ ID NO: 28242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcaagggagcttatcttttcttgcgata

SEQ ID NO: 28243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcaatcggtacatgttcccgaggatgtt

SEQ ID NO: 28244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcacggatctctctgcccactcgccggg

SEQ ID NO: 28245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcagttggtttggttaaggcgttgagcg

SEQ ID NO: 28246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcattctcggaagcgtgtctcgaatatg

SEQ ID NO: 28247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtccactttggctcagtggtaggaaggcc

SEQ ID NO: 28248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtccagctcgttaagtaaggtacctttat

SEQ ID NO: 28249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtccaggccgagcccaatgaatttgccgc

SEQ ID NO: 28250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtccatgagaagagtccttgcaggtttcc

SEQ ID NO: 28251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtccgaggtggctcctcttgtgctctatc

SEQ ID NO: 28252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtccggccagcttgttcgagttactggga

SEQ ID NO: 28253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtccggtagcgcagactggtgctgatgcg

SEQ ID NO: 28254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcctgttcgatatgatcgatcttgactt

SEQ ID NO: 28255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtccttgtctcctcgtgtgcatgtttgca

SEQ ID NO: 28256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcgagcaccgattcatcttgtcggaaaa

SEQ ID NO: 28257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcgaggagatcgcgggtgtcgttagagc

SEQ ID NO: 28258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcgagtgggtacgggacggggacagcgg

SEQ ID NO: 28259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcgccaacaagaaacgggattcttgcga

SEQ ID NO: 28260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcggctaggagtaggctgccatacgttt

SEQ ID NO: 28261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcgggaggtctacggtggaccctgcttg

SEQ ID NO: 28262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcgggcggggcaacggaacggtcttata

SEQ ID NO: 28263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcggtacgttcggggcttgttaaggctc

SEQ ID NO: 28264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcggtccaaagagtcatggatcctcggt

SEQ ID NO: 28265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcggtgtcggtcgaactgcggttcagct

SEQ ID NO: 28266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcgtaagggggtaccgggcggggtggcc

SEQ ID NO: 28267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcgtacgtttaatagttgcgtttacgta

SEQ ID NO: 28268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcgtgagtaagaaatttgaatgctcctt

SEQ ID NO: 28269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtctacgcagcgtcttttggcttgacgtt

SEQ ID NO: 28270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtctacttgcatttttcacacgaagttgc

SEQ ID NO: 28271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtctagaagatggaacgactgctgctgag

SEQ ID NO: 28272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtctcacaggctaggctcgtcataatctg

SEQ ID NO: 28273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtctcgcctgttacctgttcgcctagcga

SEQ ID NO: 28274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtctgccacgattcggccgttagtttgac

SEQ ID NO: 28275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtctgcccaattcctgacttgagcaggtg

SEQ ID NO: 28276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtcttatctgccaggcctcagcattttgc

SEQ ID NO: 28277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtctttgtttatggtgtatttatttatca

SEQ ID NO: 28278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgaagaagttggtcattgtagtttcttg

SEQ ID NO: 28279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgacctcgcgataagcctacgccaggtc

SEQ ID NO: 28280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgagacccgtgagtactgtactgcggat

SEQ ID NO: 28281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgagatccctcctttgcgttctcggact

SEQ ID NO: 28282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgatcgatcatgtgtaatgcgtacgccc

SEQ ID NO: 28283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgattgtagcttcgccaagtggtacgca

SEQ ID NO: 28284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgcaccgagttaacggccgcaaacgacc

SEQ ID NO: 28285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgccctctgcgactgtcctgtacatgta

SEQ ID NO: 28286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgcgacccgcgaggctctagctgtggga

SEQ ID NO: 28287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgcgagatccggcgattatatgcacagc

SEQ ID NO: 28288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgcggacgtgcagcgttgtgttcgcttg

SEQ ID NO: 28289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgcggcagcgttatgtgacgcatcgggt

SEQ ID NO: 28290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtggaacctttcagatagggcgtatgtta

SEQ ID NO: 28291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtggaagccgcctcttccacctgaggtcc

SEQ ID NO: 28292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtggagctgataaggcggagtcaggtggt

SEQ ID NO: 28293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtggagtgacccgtatgctttgttctcgg

SEQ ID NO: 28294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtggattactggtaaactgggacagcgct

SEQ ID NO: 28295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtggcaaaactccgacgtccgctttgcac

SEQ ID NO: 28296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtggcaggggagttttattcttgggtaga

SEQ ID NO: 28297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtggcgttcagctggtcgttacacggtaa

SEQ ID NO: 28298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgggggatgtcttaggatccacacgtac

SEQ ID NO: 28299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtggtataggggtggccagtcaagcgctc

SEQ ID NO: 28300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtggtgaatacactgtacaggagttcatg

SEQ ID NO: 28301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtggtgcccgtacgtatgggattacaagt

SEQ ID NO: 28302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtggtggggaatgtctcccgtcagtaact

SEQ ID NO: 28303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtggttaggtaaggagtggtcctattgga

SEQ ID NO: 28304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtggttgcgtcgaccgaatccaccgggtc

SEQ ID NO: 28305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgtagtaactggtagttgtcagtgcggg

SEQ ID NO: 28306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgtcacatctttcctcgatgaccaggct

SEQ ID NO: 28307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgtgcctcgcccgccaaggttagacatg

SEQ ID NO: 28308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgtgcggagagcgcaagtcgtgtgcctt

SEQ ID NO: 28309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgtggtgtgcggccggaccctggatagc

SEQ ID NO: 28310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgtgtgctagcgtacgattacctctgcg

SEQ ID NO: 28311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgttggtcgaactggacatggtttgctg

SEQ ID NO: 28312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgttgtggagggggtcattactacatgg

SEQ ID NO: 28313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtgtttacaacattcgcaatgcagttatc

SEQ ID NO: 28314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttaatcccagcttatgcatgtgttgacc

SEQ ID NO: 28315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttacgcaacacgtccgttattctgatgc

SEQ ID NO: 28316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttagggatgtcacaacatgcggttgttc

SEQ ID NO: 28317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttatatgttctattattgggttgacgcc

SEQ ID NO: 28318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttatgcacttcccgctacactcattgtt

SEQ ID NO: 28319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttattgcacggctccattttttggcgtc

SEQ ID NO: 28320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttcaataatggataacctgtatgtgcgg

SEQ ID NO: 28321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttcacaggcgggtctccgtggtcgcaag

SEQ ID NO: 28322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttcagcgggatagcatgtgggccgagct

SEQ ID NO: 28323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttcagtgtcagatacggtcgattggtag

SEQ ID NO: 28324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttcagttagtggagtacaaactggaccg

SEQ ID NO: 28325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttccaagttacctccacccgagtgctcg

SEQ ID NO: 28326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttcctactctgctgtgctgttgggcctt

SEQ ID NO: 28327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttcgcagcgtcagaagttgtgtacaggg

SEQ ID NO: 28328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttcgtaacaaccgagtagaatcggctcg

SEQ ID NO: 28329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttgacgggcaggtcaaccggggaagctg

SEQ ID NO: 28330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttgagttatgcactggggaatgaaagag

SEQ ID NO: 28331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttgcgtgcataactgctgtgctgcgtta

SEQ ID NO: 28332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttggaaacgccggtagcgcttgcctttg

SEQ ID NO: 28333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttggcgacgtccttgcacgttgttcgac

SEQ ID NO: 28334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttggtctgagagaagctatcacctcact

SEQ ID NO: 28335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttggtggccacaaacagttggacctggg

SEQ ID NO: 28336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttgtggcctcaagtaggcaccgagtagc

SEQ ID NO: 28337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttgtgtgttttgacttagtacattgggc

SEQ ID NO: 28338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtttcgcaagcaaggtcgagttgtatagc

SEQ ID NO: 28339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtttgagatgctttggcaatattagcggt

SEQ ID NO: 28340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtttgcttacagagaccacgccacctccc

SEQ ID NO: 28341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgtttgtgtacaccgcggtcacacttaagc

SEQ ID NO: 28342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcgttttgtcattcggacctcggacatcgcc

SEQ ID NO: 28343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaaaagacgggcaattgctaaacgatgcc

SEQ ID NO: 28344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaaaccggttttactcatcatgtggcttg

SEQ ID NO: 28345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaaaggaatccctccggatcctaaaatgg

SEQ ID NO: 28346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaacagcttacgtggagtaaggcactgcg

SEQ ID NO: 28347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaaccctcctcaccgcttacctaaccctg

SEQ ID NO: 28348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaactagtgttcaagtcacctctcgggga

SEQ ID NO: 28349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaagacaagcgacagattttgtacttagt

SEQ ID NO: 28350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaagagtctcctgcgatcccgctagttgt

SEQ ID NO: 28351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaagcaatcagggaacgctcagagcaggc

SEQ ID NO: 28352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaaggaaaggtacatgcagggtttcggag

SEQ ID NO: 28353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaagtacgcagattaagcagctgcgccga

SEQ ID NO: 28354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaagtccatcatggtttgcctgaattttg

SEQ ID NO: 28355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaatcttgcggttctgcgggctcaagtat

SEQ ID NO: 28356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaatgttagaactcgacaccccacccagc

SEQ ID NO: 28357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaattgcatttcactgctcccttcgtctg

SEQ ID NO: 28358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctacaatcggtttatccagtttcgtggccg

SEQ ID NO: 28359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctacacacctcagttggcgagtgaggcacg

SEQ ID NO: 28360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctacacagcatcgttgacaaaatcggtacg

SEQ ID NO: 28361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctacacgacgacactgctaaacaaggctgt

SEQ ID NO: 28362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctacactggtttaacaggccggagttgcaa

SEQ ID NO: 28363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctacagccattacgggcttggctatcagta

SEQ ID NO: 28364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctacatctgaggtgggcgtcatttgcgaat

SEQ ID NO: 28365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctacattgtacctcggagacttttcagctt

SEQ ID NO: 28366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaccaggccggccgtaccaagactgcgac

SEQ ID NO: 28367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaccatccgagctcttcgttgccgtacct

SEQ ID NO: 28368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaccccgctccgaatgtgggactacaacg

SEQ ID NO: 28369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctacccgttttggacccctccttctgtgca

SEQ ID NO: 28370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctacctatccggctatggggttatgggctc

SEQ ID NO: 28371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctacgaagccggcggccgagttctccccac

SEQ ID NO: 28372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctacgagacctatttgcacgggaatgctta

SEQ ID NO: 28373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctacgcgtatgtgcgacaatccaacaaggt

SEQ ID NO: 28374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctacgggaaaattctggggacgccggccct

SEQ ID NO: 28375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctacgggtgctagttcaatgtcagctcggg

SEQ ID NO: 28376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctacgtaaatttttctaaacactccgtctc

SEQ ID NO: 28377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctacgtaggggatgttggcaaggcacgctt

SEQ ID NO: 28378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctactcataaaggcaaagtccgagcccttt

SEQ ID NO: 28379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctactcataccaacatcgaatggtgaatgg

SEQ ID NO: 28380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctactcgaccctctgtcagctctgctgtcg

SEQ ID NO: 28381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctactgagaaagtacactgcaccggatata

SEQ ID NO: 28382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctactgggcattcgcgtcaagagttcccct

SEQ ID NO: 28383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctactgtcgtctcaattgccccgtggtatc

SEQ ID NO: 28384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctacttgcttatatcggtcgatgctctatg

SEQ ID NO: 28385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctagagactcactcctttgtgttgcgacat

SEQ ID NO: 28386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctagattctgtatcgcgaggcatgatcagt

SEQ ID NO: 28387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctagcaagcaacgggcaaagtctactccga

SEQ ID NO: 28388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctagcagccggtagggtacgagaggtgggc

SEQ ID NO: 28389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctagcttgataaccccgtcagcgttcgttg

SEQ ID NO: 28390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaggacagttattgacgcgcttcctgcct

SEQ ID NO: 28391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaggactcgtaggtgtgtactaaaaagaa

SEQ ID NO: 28392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaggatgggccttgagtcaggggtaaggc

SEQ ID NO: 28393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaggcaaattgagcacggcaaggtgaacg

SEQ ID NO: 28394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaggcatatgaccctgtgccccagtctgc

SEQ ID NO: 28395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaggcgggtactgaatgaacacggaacta

SEQ ID NO: 28396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctagggagctcaaacacgagacgacatgcc

SEQ ID NO: 28397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaggggcactgctgcggtaggtccggccg

SEQ ID NO: 28398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctagggtgcatggccatagaacctgtgtca

SEQ ID NO: 28399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctaggttgaccggaagcatcggagctttgg

SEQ ID NO: 28400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctagtcaagacgacggtatgcgtccgatcc

SEQ ID NO: 28401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctagtcgccacggcgggagtgccgtataca

SEQ ID NO: 28402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctagtggggcgatgcactttgacacgatcc

SEQ ID NO: 28403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctagtggtctaccgccgcaatacctggctt

SEQ ID NO: 28404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctagtgttggagggatgtatccactaggcg

SEQ ID NO: 28405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctataaacgagtgttcttgcctcccccgtg

SEQ ID NO: 28406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctatacactatccgtagtcgttggtaaacc

SEQ ID NO: 28407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctataccgagagcgtgtaaccccgctagga

SEQ ID NO: 28408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctatcatggttgtccctggcaaaggcagtg

SEQ ID NO: 28409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctatccaacactttatcagccgtttgtccg

SEQ ID NO: 28410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctatcccgatcaccgagtcaggtcgtaaag

SEQ ID NO: 28411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctatcggccgcgttaagggtatcatcagtc

SEQ ID NO: 28412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctatcggtgaaatatgtcatcttaattgcc

SEQ ID NO: 28413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctatgatgtgtgttacaggtgccgactctg

SEQ ID NO: 28414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctatgctcgtagtctacctgtccgacagag

SEQ ID NO: 28415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctatggtcttagatagggaggttttatctt

SEQ ID NO: 28416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctattccgggtctggatgttggtttggtga

SEQ ID NO: 28417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctattgggctttccatgagttatgttagga

SEQ ID NO: 28418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctattgtacctaacgtgtgtaatccgttgt

SEQ ID NO: 28419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctatttacaggaacgtaggactaggttctt

SEQ ID NO: 28420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcaaagtcaccggctgttctcgactcgtc

SEQ ID NO: 28421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcacatgtccgtctttaatgctttcccgc

SEQ ID NO: 28422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcacccaccgatgcgtttctttgacgccg

SEQ ID NO: 28423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcaccgtattccaacgcgggcttgagctg

SEQ ID NO: 28424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcactaaacttgcacaggccgtgttcctc

SEQ ID NO: 28425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcactgtgagtggctgaagatcggttccc

SEQ ID NO: 28426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcagcaggccgcgggatgtccgttaaaag

SEQ ID NO: 28427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcataagcctacccaggatttccactgcc

SEQ ID NO: 28428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcataatagaagctatcggacgaggcata

SEQ ID NO: 28429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcatcatggcactacgagttggtgacccg

SEQ ID NO: 28430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcatctatctttctcaattggcggtggtt

SEQ ID NO: 28431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcatgctggctcctgctcatgctgccgcg

SEQ ID NO: 28432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctccaaagaggtgacaaggcagacagcact

SEQ ID NO: 28433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctccaagtcgggcgatacccggagtacaca

SEQ ID NO: 28434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctccagggtcattccgatgtacaggggggc

SEQ ID NO: 28435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctccagtgctctgacgaccggattctatgt

SEQ ID NO: 28436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctccatattcgcgattcgatcggcatagca

SEQ ID NO: 28437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctccatccggcgaacatggccgtggcgaac

SEQ ID NO: 28438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctccatcgttcgcacgcgatcgggaggtag

SEQ ID NO: 28439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctccatggcaggtgtgggcgtgccgacggg

SEQ ID NO: 28440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcccacgattagctctgactaggatccct

SEQ ID NO: 28441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctccccctaacgcccctagacatctccgcc

SEQ ID NO: 28442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcccggatcacgatgtgtatgcataggta

SEQ ID NO: 28443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcccgggttaggcatgccgtgtggaacaa

SEQ ID NO: 28444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcccgtgtgctgattttaaagagagtgtc

SEQ ID NO: 28445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctccctcggcgtatgggaacggggcttaaa

SEQ ID NO: 28446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctccgaccaggtggcctcaacttgtttgct

SEQ ID NO: 28447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctccggatattcagtcatcctcacctccgg

SEQ ID NO: 28448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctccgggacgtgggtgaggtgccggcctgc

SEQ ID NO: 28449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctccggtgtcaataccatgggggacgcaat

SEQ ID NO: 28450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctccgtacggccacttgttactgcgactga

SEQ ID NO: 28451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcctcaggtgtagctagttagtattgacc

SEQ ID NO: 28452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgacccatagtatgcactagcgggcctg

SEQ ID NO: 28453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgaccccataccataagctcggttcgtg

SEQ ID NO: 28454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgacgatcacgcgttactcttgccggta

SEQ ID NO: 28455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgagacgattcctcgtcgtttcccagct

SEQ ID NO: 28456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgagggcgacggaagcacatagggcaga

SEQ ID NO: 28457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgagggtagcggtcgcgcgtaacagtac

SEQ ID NO: 28458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgcagaacgtcataccgttaaagtaggt

SEQ ID NO: 28459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgccaaccgccagtcgggggtccggggc

SEQ ID NO: 28460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgccactctactttgactctcaggcgcc

SEQ ID NO: 28461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgccagtccctcttctcgatgggtgggt

SEQ ID NO: 28462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgcgtctcggcattattcggtatcctcg

SEQ ID NO: 28463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgcttctgtcattgttgatccctacacg

SEQ ID NO: 28464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcggacacactgatcgatggttccagctc

SEQ ID NO: 28465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcggagagacaacgcgagttagcgactgc

SEQ ID NO: 28466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcggaggacaggcgtggggtcgctgcatg

SEQ ID NO: 28467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcggatccgcttgtcgccctgttgatgta

SEQ ID NO: 28468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcggccgcggcgttttgggctgtgtatga

SEQ ID NO: 28469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcggcgggaagggtattattagccgacac

SEQ ID NO: 28470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgggaactctcccaggttctatcaccac

SEQ ID NO: 28471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcggggccgcggttggtaaaaggctcgtt

SEQ ID NO: 28472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgggtgccggggagcggctctgctggtg

SEQ ID NO: 28473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcggtagtaatacacgtcgcaacggtctt

SEQ ID NO: 28474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcggtatggtattgcctcgaagtccagtc

SEQ ID NO: 28475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcggtggtacatgggggtgagctgggctt

SEQ ID NO: 28476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcggttggatgtcatactaccatctgtcg

SEQ ID NO: 28477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgtacgtggattaatggggctgctcggt

SEQ ID NO: 28478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgtgtcaagttcttctgggcggtggcta

SEQ ID NO: 28479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgttccgtaaagatcgtatatatggccg

SEQ ID NO: 28480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgttggatggttagcatctcggattcgt

SEQ ID NO: 28481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcgttgtatagcacctaggtaacgtacca

SEQ ID NO: 28482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctctaacatgaatcgaaatgtccggcatag

SEQ ID NO: 28483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctctactcgataccgggcataggttgtgtt

SEQ ID NO: 28484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctctagcagtcaagtgttgtccaggtcccg

SEQ ID NO: 28485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctctagcttgtaatcgtatgctgtatcctg

SEQ ID NO: 28486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctctccatcagtggcctacaggcgtggccg

SEQ ID NO: 28487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctctccgtaggtatgctcccgaatactatc

SEQ ID NO: 28488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctctcctagggcgtggggactcaactgttt

SEQ ID NO: 28489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctctcctcggatcaagatgtaataagccat

SEQ ID NO: 28490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctctcgttaatgttccccaacatgtaatcg

SEQ ID NO: 28491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctctctgctaatgcccaatagcaaccggtt

SEQ ID NO: 28492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctctctgtagcatcattttcacgaactgga

SEQ ID NO: 28493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctctggccattaggcggaactctcggtcgg

SEQ ID NO: 28494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctctgggcctccgaattaccgaagccgtga

SEQ ID NO: 28495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctctgttattcgtcgtagttcatgcgaagt

SEQ ID NO: 28496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctctgtttttgcgccacaggggcatcatat

SEQ ID NO: 28497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcttaaggacgtacttgtttgatccagga

SEQ ID NO: 28498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcttccgcgtgtgggcgctccctgattgc

SEQ ID NO: 28499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctcttccgtcggaaaatacgtcggggcgag

SEQ ID NO: 28500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctctttaaggtcaagattcttatgactatt

SEQ ID NO: 28501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctctttcagccttgtgggatctatgtctgc

SEQ ID NO: 28502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctctttccgggccgtactggtctctggtgt

SEQ ID NO: 28503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgaaaggcgtactgccgcgacctcatacg

SEQ ID NO: 28504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgaacaccggatcgtcagtccaatctggc

SEQ ID NO: 28505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgaacccactatgcgctcggttgttcctt

SEQ ID NO: 28506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgaacggtcgcattgtggcatggtcaccg

SEQ ID NO: 28507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgaagataaatcgcgtttacgtagagata

SEQ ID NO: 28508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgaagatcgcgtttccgtaaaaatggatc

SEQ ID NO: 28509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgacaggtgtttctttggtattccttaca

SEQ ID NO: 28510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgaccatacgtctcaaacggggcatagat

SEQ ID NO: 28511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgaccgtggtgcacgctgccactagcatg

SEQ ID NO: 28512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgacgacttaattatgaaaggtttgtcaa

SEQ ID NO: 28513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgacgattgaccttactggccgggtgcag

SEQ ID NO: 28514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgacgtagcaccgggacgcgatatgagcg

SEQ ID NO: 28515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgagagtttagtgagggggggaaagcgca

SEQ ID NO: 28516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgagcaatacgtcttcacgagagcagagt

SEQ ID NO: 28517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgagcatttccgacggcgggaaaaacagg

SEQ ID NO: 28518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgagccaagcccgggttgtaactgtgggc

SEQ ID NO: 28519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgagcgtccctccgcatcttcaatccatt

SEQ ID NO: 28520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgaggctcaccactgttgcccggaacgtt

SEQ ID NO: 28521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgagggcttttacttccgcaacagatctt

SEQ ID NO: 28522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgaggggtattgcgactgtcggtgccatg

SEQ ID NO: 28523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgagtagggtatggctgttacaatccaca

SEQ ID NO: 28524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgagtatggggctcacttcaccctcgatt

SEQ ID NO: 28525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgatagtcgggtgggattctcaagggtgc

SEQ ID NO: 28526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgatgaagtcacgtaatggtggatacgcc

SEQ ID NO: 28527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgatggttcagttggaattggtgcatggg

SEQ ID NO: 28528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgcaaacgaacacgggctgtcatcggtgg

SEQ ID NO: 28529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgcaatttggccctatacgtaacggccct

SEQ ID NO: 28530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgcacccctcgttgcatctcctgtccttc

SEQ ID NO: 28531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgcagatactcctgatgcatgattcagcg

SEQ ID NO: 28532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgcaggggaaggtaggctatcgttaccga

SEQ ID NO: 28533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgcagttcaggagggtcttggtttttccg

SEQ ID NO: 28534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgccgagacggaaggttgatcgaaccggc

SEQ ID NO: 28535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgccgtgcgttgagcaaccttgcgcaaag

SEQ ID NO: 28536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgccttaatagctgtggtaattccttggg

SEQ ID NO: 28537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgccttcttctgttgatggtcctggtgtc

SEQ ID NO: 28538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgcgaaggcggtaccttaaccaaggaagt

SEQ ID NO: 28539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgcgaatccgtaatctctccacagcaccg

SEQ ID NO: 28540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgcgccttttaaaatatattcttgctgtt

SEQ ID NO: 28541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgcggtacaaggtgctagaacaggaggac

SEQ ID NO: 28542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgctcacatccggatagtgtagccgttta

SEQ ID NO: 28543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgctctcgcattatttcgttaccttggcg

SEQ ID NO: 28544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgctgggccactgactatctggtcgagtt

SEQ ID NO: 28545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgcttacggggcagttgagtctcgacgct

SEQ ID NO: 28546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgcttagggaaccctcatggactggtgtg

SEQ ID NO: 28547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgcttgtaaatgttcgtcggcggtgcggt

SEQ ID NO: 28548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgctttcgctaacgttatgtagggtatgg

SEQ ID NO: 28549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggaagtttagggaggctggctttctttg

SEQ ID NO: 28550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggaatgggggcaaggatgtcgttggacc

SEQ ID NO: 28551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggacgcgagctacctcagagtttgcttg

SEQ ID NO: 28552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggactgacggcagctggttgattgggac

SEQ ID NO: 28553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggacttgatcaccagtcatgcgtgctac

SEQ ID NO: 28554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggagagcaaggttcatcaagcatgttgt

SEQ ID NO: 28555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggaggaggccgtcaggtgagctgacgaa

SEQ ID NO: 28556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggatcgggactcgcgatggtgcctgtcg

SEQ ID NO: 28557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggatggggtcctggattacggccgtgct

SEQ ID NO: 28558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggattacggttagtccatcgccttcctc

SEQ ID NO: 28559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggcaatcctctaacgagatcccactgtg

SEQ ID NO: 28560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggcactctgattatcattatgccgctgt

SEQ ID NO: 28561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggcattctctcgatccgtcagcaagtga

SEQ ID NO: 28562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggccggcttgcgcttatcatggcctttc

SEQ ID NO: 28563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgggagtgaagtgtcgccttggacgggac

SEQ ID NO: 28564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgggagtggctgacccccaataagggatc

SEQ ID NO: 28565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgggatcaattacgtaggttagcaatctc

SEQ ID NO: 28566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgggccctgtacggttgcgtatggatggt

SEQ ID NO: 28567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggggaccggacaacgaggtcttatggcg

SEQ ID NO: 28568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggggtaaggagttacgaacttcattttg

SEQ ID NO: 28569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggggtcggcagtccagattcgtgagaga

SEQ ID NO: 28570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggggtcttcatgtgcggtgtgcaatctg

SEQ ID NO: 28571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgggttataaaattttactttggttcgtt

SEQ ID NO: 28572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggtaatgctcaatcctgctagttcggtg

SEQ ID NO: 28573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggtactctaaggcatgtggttcgcactt

SEQ ID NO: 28574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggtcaggaggattatgttatcggggctt

SEQ ID NO: 28575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggtcagtgattaacactgggttgctgtt

SEQ ID NO: 28576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggtccggtgctaacccgtttccgtgctc

SEQ ID NO: 28577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggtcgagttaatcatcaatggcgagttt

SEQ ID NO: 28578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggtgtcgtgaggtacgaagttcgggacg

SEQ ID NO: 28579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggttagacacccggttggacagatgtac

SEQ ID NO: 28580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctggtttgcctccaagcagggaggtagtag

SEQ ID NO: 28581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtaacgggcgggatggttcgggctgatg

SEQ ID NO: 28582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtagactcctttttatatacctacccgg

SEQ ID NO: 28583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtagccgtttcgggataacactttattc

SEQ ID NO: 28584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtagggtcagtcgaggacaaatgcttac

SEQ ID NO: 28585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtcaacttggcaccgccatgggttacga

SEQ ID NO: 28586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtcacgtgaatgatttgtaagttgtttg

SEQ ID NO: 28587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtcagatctattcctttcccgtgtggga

SEQ ID NO: 28588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtccgatgtctcccgtcacgtactcctt

SEQ ID NO: 28589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtccgttgcctaagctgttcaccgcctt

SEQ ID NO: 28590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtcctattcagttccacggtttcggcct

SEQ ID NO: 28591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtcctcctggaagggatcggtacgctgt

SEQ ID NO: 28592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtcgtcaccagtgatctatcggtccctt

SEQ ID NO: 28593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtctcgcagtcgtgtggtagctgcacgt

SEQ ID NO: 28594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtgaatatggccgagtggaagtggcgcg

SEQ ID NO: 28595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtggcagggtaggtgcaaccatgagacg

SEQ ID NO: 28596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtggccaaggaggtacccgcgacttgcc

SEQ ID NO: 28597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtggtcatttatcagcgtgtgtgcacct

SEQ ID NO: 28598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtgtcgtgaatccggcgcgtctaggtcg

SEQ ID NO: 28599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgttatggagttaagctgtattccaggat

SEQ ID NO: 28600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgttcaggttacagatttgtcgcttgcgg

SEQ ID NO: 28601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgttcatgtcctcgcgcagaactagggga

SEQ ID NO: 28602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgttgaggaggaggtaatccattagtcca

SEQ ID NO: 28603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtttaagacggcggaatttgctgcgagt

SEQ ID NO: 28604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtttgaacctagcgacggtgttttggga

SEQ ID NO: 28605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgtttgctgcaaggactgtatactttacg

SEQ ID NO: 28606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctgttttcccgtgtccagctttcccggaat

SEQ ID NO: 28607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttaaggccttccttccccaagtccaggag

SEQ ID NO: 28608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttaatggatcacgagagaacttggctttg

SEQ ID NO: 28609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttacggggggcactctggctcacacgcac

SEQ ID NO: 28610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttactcggagaactaataccgtcgcacta

SEQ ID NO: 28611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttagcagggatagggtagtgcatgcagcg

SEQ ID NO: 28612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttagctcatgtgcatgcctttgattgaac

SEQ ID NO: 28613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttagctgtactcatcacgagtggcggtac

SEQ ID NO: 28614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttaggtatgtgtgtagattgagaggtcac

SEQ ID NO: 28615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttaggtgtgcatcacgaataacctcgcgc

SEQ ID NO: 28616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttagtaggcaactcaaaccctggggcttg

SEQ ID NO: 28617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttagtgttcggccatctgggagttcgacc

SEQ ID NO: 28618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttagttcgaagtccaatatattgttgcgg

SEQ ID NO: 28619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttatccaggaaggcgtgcattaccgctgg

SEQ ID NO: 28620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttatccggtgactcccttcgacccttttg

SEQ ID NO: 28621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttatcgttaagacgcagagtccagacact

SEQ ID NO: 28622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttatctcgagcacgcattacgacgtcccc

SEQ ID NO: 28623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttattcggtatagggatactggtcccaac

SEQ ID NO: 28624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttcaaatagcggataactacggaacccac

SEQ ID NO: 28625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttcacatacatgctcgtgcgcatccgaca

SEQ ID NO: 28626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttcaggaacatgactcctcatagggtggg

SEQ ID NO: 28627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttcatgcatagtcttcccaaagatgggcg

SEQ ID NO: 28628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttcatggggcgggtgatatagcggaaact

SEQ ID NO: 28629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttccaaacgattgggtctacagggcggta

SEQ ID NO: 28630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttccaatgaccgtgcgcacactgcgccaa

SEQ ID NO: 28631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttccaattgggtggtcaaggttatcggcg

SEQ ID NO: 28632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttccgtatcttcattggtatttgaagttt

SEQ ID NO: 28633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttccttatattcccattcgtaggtagatt

SEQ ID NO: 28634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttcgaacagctttgcggcgccccaaggat

SEQ ID NO: 28635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttcgagctgggccgattaccctgaacttg

SEQ ID NO: 28636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttcggttttccggctaccaggtgttcttt

SEQ ID NO: 28637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttcgttacgtacgttgttccggtcggtgc

SEQ ID NO: 28638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttctatgtctgctttctgttaaccacggc

SEQ ID NO: 28639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttctggtcaacacccaatcgtcgtcaccg

SEQ ID NO: 28640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgaaataactcattgattcgtcgactat

SEQ ID NO: 28641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgacaacgggttgtgcggttgattttgt

SEQ ID NO: 28642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgactttgtgcgtacacggggctagttg

SEQ ID NO: 28643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgagcttttatgtccgcacagtctagtt

SEQ ID NO: 28644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgaggttacgctgactgctacgaacgct

SEQ ID NO: 28645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgagtgtctggtgttcgagatgggggaa

SEQ ID NO: 28646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgatatttgagagtatccgtgttacccc

SEQ ID NO: 28647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgatttgtcccttttgtcgagggcttgt

SEQ ID NO: 28648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgcaagcacggactgtgtgcatgaggcg

SEQ ID NO: 28649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgcatcatggcattgtagatccaacagc

SEQ ID NO: 28650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgcgcacattatcgctagtgtagtgtca

SEQ ID NO: 28651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttggaaaggccggtcggcccttgagtccg

SEQ ID NO: 28652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttggagggtctagcccgggatccagcgtg

SEQ ID NO: 28653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgggtgattgtatcgggttacacgtttc

SEQ ID NO: 28654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttggtaagggagcgtccgtctgctttttc

SEQ ID NO: 28655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttggtatcctgatgaatgggttatgttta

SEQ ID NO: 28656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgtaagattttatcccatgtactgagta

SEQ ID NO: 28657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgtacatggtgcgtcttccctgggtgag

SEQ ID NO: 28658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgtcgatgtccctcgaaacacgtgggag

SEQ ID NO: 28659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgtcggaaagcattggccacttctgtct

SEQ ID NO: 28660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgtcttctggttgccggtgtagttcatt

SEQ ID NO: 28661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgtctttccgcgtttgaaatcctattag

SEQ ID NO: 28662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgtgacgcttttggctgcggcgaacatt

SEQ ID NO: 28663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgtggggacgcgttgtggacaaaggctg

SEQ ID NO: 28664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttgtttatagaccacttttaggcatctgg

SEQ ID NO: 28665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctttacgggaagcaggctaaaatgcgcttt

SEQ ID NO: 28666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctttagcacgacaggacgggtggtacgggt

SEQ ID NO: 28667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctttaggaactgtgctactccgactagtgc

SEQ ID NO: 28668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctttaggtaatgctcgatgaatgttccagt

SEQ ID NO: 28669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctttataatcgggacatggatctttgcacc

SEQ ID NO: 28670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctttcaccagggcttaacacacgttggcga

SEQ ID NO: 28671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctttcagatagtcatctcggcgaaatgtaa

SEQ ID NO: 28672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctttcgggctacggttatacacaaggcaat

SEQ ID NO: 28673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctttcgttctcattttgtgtgtgggcgatg

SEQ ID NO: 28674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctttctctgttcttctactcgccgttttag

SEQ ID NO: 28675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctttgacgcgtagtgcttgccagggctgcc

SEQ ID NO: 28676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctttgactctagtggtaatattggtggtat

SEQ ID NO: 28677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctttgagatctgcgtgttgttagcgttaca

SEQ ID NO: 28678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctttgcagccgcgcgtaagatctcgttagg

SEQ ID NO: 28679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctttggccggcccagagctccatccgctga

SEQ ID NO: 28680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctttggtcgtgatctcttggcaattgaatg

SEQ ID NO: 28681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctttgtaacggggctattacaggcgcgaac

SEQ ID NO: 28682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgctttgtgaacgtgccccagggtgactaacg

SEQ ID NO: 28683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttttactgcgcttgttcgggtagtcgtcg

SEQ ID NO: 28684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttttgggtggtgttttcagatactgtgag

SEQ ID NO: 28685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgcttttttagggatctgcaattatgacgcgg

SEQ ID NO: 28686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaaaacactgccactcagcgggcccgggt

SEQ ID NO: 28687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaaaggtcaaagtgctagggggacggaag

SEQ ID NO: 28688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaaagtacgcgctggagcctaagaggcct

SEQ ID NO: 28689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaaataaacgaatcgattgtctattacgt

SEQ ID NO: 28690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaacactggttgaattcatccgaagcaaa

SEQ ID NO: 28691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaaccaaagtgcgctatctccaccgtacg

SEQ ID NO: 28692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaaccaggctatgttgatgcttcgtggcg

SEQ ID NO: 28693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaacccacgcttacacggctgacgcaacg

SEQ ID NO: 28694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaacctttcgctcatcgggcgccgcactg

SEQ ID NO: 28695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaactctgtttgtggccatgtacataacg

SEQ ID NO: 28696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaagagttctcgaacggccgctggacggc

SEQ ID NO: 28697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaagcgactcgtgtatcggcgtggtactc

SEQ ID NO: 28698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaagctcgcgtattagagggctacgtctc

SEQ ID NO: 28699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaaggcgtgatcttgtcttaagttgggag

SEQ ID NO: 28700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaaggtgggacttgcaatcagcctagtca

SEQ ID NO: 28701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaagtatcgtgaagtcttcaagcctcatc

SEQ ID NO: 28702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaagtatcgtttgatgccggcatagatca

SEQ ID NO: 28703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaagtgaagcgacgagggctcgagccggc

SEQ ID NO: 28704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaagttcattcttgtgacctacatgctcg

SEQ ID NO: 28705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaatagaccgtgtcggaggttgtctcctg

SEQ ID NO: 28706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaatatccgataaacttgggcagaccgaa

SEQ ID NO: 28707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaatgattacgttctgggcgcagctgtaa

SEQ ID NO: 28708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaacaagaaagcctcctaaacgttttctct

SEQ ID NO: 28709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaacaccggtgcggatttaggatgtatggt

SEQ ID NO: 28710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaacagatgatcagcgtccggctgtgcacc

SEQ ID NO: 28711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaacagccattgaacgggttcgttggtatt

SEQ ID NO: 28712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaacagtatctagtgcaatctcaccgggtc

SEQ ID NO: 28713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaacattgggaacacggcctcttctcggct

SEQ ID NO: 28714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaccatctaggcttttgtgttacgcgggg

SEQ ID NO: 28715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaccccagttgtaggtttaaaaggtccgt

SEQ ID NO: 28716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaacccgagacaagaggtatgcgaagggcg

SEQ ID NO: 28717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaccgacggcaaggtgggcactaattatc

SEQ ID NO: 28718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaccgcacatgctccctgtttccttggaa

SEQ ID NO: 28719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaccggcagtgtatccaacatcacgcggg

SEQ ID NO: 28720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaacctccacccataatgccgtttggacgg

SEQ ID NO: 28721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaacgacttttttcaccgtttttcgcgtcc

SEQ ID NO: 28722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaacgccggggcagccaactgtgagaggag

SEQ ID NO: 28723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaacggacaccgacagcttgcagtccaggt

SEQ ID NO: 28724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaacgggatgcaggtagacgtgttacgggg

SEQ ID NO: 28725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaacggggctcaggttgttcacttaaatgc

SEQ ID NO: 28726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaactagagcgcagttacgaggtcagacgg

SEQ ID NO: 28727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaactgcacatggtcatacgcctgttaatg

SEQ ID NO: 28728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaactgcggaagcttacaagtggggacgaa

SEQ ID NO: 28729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaactgtcaggcagatcgacacaagcacgg

SEQ ID NO: 28730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaacttcaaagtctcagatgcgtacgacct

SEQ ID NO: 28731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagaagtgtatcgcttagacgcggagtcg

SEQ ID NO: 28732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagacaaccatgcttaacgcttaaccgtg

SEQ ID NO: 28733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagacccgattcaggggcggggacggtag

SEQ ID NO: 28734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagactcagtctggcgcgatgagtattcg

SEQ ID NO: 28735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagagcatcggcgaggagatgcaccgcaa

SEQ ID NO: 28736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagatattggatgttatggtactgcgggc

SEQ ID NO: 28737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagatggattcagcgcaacgtaccttggc

SEQ ID NO: 28738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagccccacccattcactggtcgcaaggg

SEQ ID NO: 28739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagccggaacgccgccgcttggctcgcgc

SEQ ID NO: 28740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagcgaacgccgagtaatgggatgcgttc

SEQ ID NO: 28741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagcgacttcgcggcaaatcaggtatggt

SEQ ID NO: 28742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagcgcacacgagcggcaattcgggttcg

SEQ ID NO: 28743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagcgcaggaattggttatgccgggcgac

SEQ ID NO: 28744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagcgtttagctagcacattatgcgaacc

SEQ ID NO: 28745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagctacatggagcgctcggtcggaactt

SEQ ID NO: 28746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagctgacaatttggattctagacatagg

SEQ ID NO: 28747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagctgggctagcaagggcaacgtaagcc

SEQ ID NO: 28748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaggaccaaaagcctttccattcatgtaa

SEQ ID NO: 28749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaggacgccaccatcgatagaagttgccg

SEQ ID NO: 28750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaggccgctgtcggtccgggtacgtgcgc

SEQ ID NO: 28751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaggctaacagtcacaccccttgcaccga

SEQ ID NO: 28752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaaggctcttcctgcggccggagtgaagta

SEQ ID NO: 28753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagggcaaacgtcattcttttcttcggca

SEQ ID NO: 28754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagggtagcatagtgccgctgtttgcaga

SEQ ID NO: 28755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagggtgaattttgaaatcctgcagggtt

SEQ ID NO: 28756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagtcaagttcgggacaatccatcagggc

SEQ ID NO: 28757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagtcgctacctgctgctactcaacggtg

SEQ ID NO: 28758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagtctcgtcgccagtccgctagcgggga

SEQ ID NO: 28759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaagtgactttctcgtgtgtttgtgcgccc

SEQ ID NO: 28760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaataacgtgtcaatatgttcttgttgtgc

SEQ ID NO: 28761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaataagtatcaaagttcgatctggccttt

SEQ ID NO: 28762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaatacaggtatcgtccatgcaaggtagtt

SEQ ID NO: 28763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaatacgattttggtcctatagtcatcgga

SEQ ID NO: 28764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaatatgatgccggtggtgctattactaat

SEQ ID NO: 28765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaatcaggacgggcggatcatacggggtgg

SEQ ID NO: 28766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaatccaggggcgtggttcaagtccgggga

SEQ ID NO: 28767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaatcgatacgatggcttaaatttctctgg

SEQ ID NO: 28768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaatcgatcaacgcggcgcattagtgcgat

SEQ ID NO: 28769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaatgacacgaaatccgtggagtctaggca

SEQ ID NO: 28770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaatgtggaggacccggaaagccggttggt

SEQ ID NO: 28771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaatgtggtggtgtaaggtttggacgctcg

SEQ ID NO: 28772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaattcaattggtcattgtgatgcgacaat

SEQ ID NO: 28773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaattttaccgtgccacgagtagcttcagt

SEQ ID NO: 28774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaatttttgtgggcggtgatcatatttcaa

SEQ ID NO: 28775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacaaaacggtgcatgtatgggcattctgt

SEQ ID NO: 28776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacaaacccataccaactgacccagcggag

SEQ ID NO: 28777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacaaattcggtgcccacgttgcgttgtcg

SEQ ID NO: 28778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacaaccaatcagaacgaatttgtcgtgtt

SEQ ID NO: 28779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacacaagattgctttcagtacccctacca

SEQ ID NO: 28780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacacacgtcaaggatgttcggtggaaagg

SEQ ID NO: 28781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacacatcgaggattcatcgcaggcctctc

SEQ ID NO: 28782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacaccgggtaatgctgtaacatcatctcc

SEQ ID NO: 28783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacaccggtgggcgcaagcactgccagggc

SEQ ID NO: 28784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacaccgtagcgaagcttcccggaatactg

SEQ ID NO: 28785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacactgcaaggcaatacgcagctggacac

SEQ ID NO: 28786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacacttcgcgactcgccctgttggctatt

SEQ ID NO: 28787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacagcaagtgcaggtcttgtggcggtctt

SEQ ID NO: 28788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacagccaggcgttgggtcagcacgcaccg

SEQ ID NO: 28789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacagcccctggtacaggtgacttatactt

SEQ ID NO: 28790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacaggcagcccacccattatacgcgtaac

SEQ ID NO: 28791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacagggactttggcggctatcctgttgag

SEQ ID NO: 28792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacatcagagtctgcaccgctactgcttga

SEQ ID NO: 28793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacatcttcatgtggcattatcacacggcc

SEQ ID NO: 28794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacatgctccaacctcctctgcacatctaa

SEQ ID NO: 28795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacatgctcggtacccgacaactgcacaag

SEQ ID NO: 28796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacatggcccagcttaactaccgggtctcc

SEQ ID NO: 28797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacattgatgagtttcgcgcttatttcttt

SEQ ID NO: 28798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccaacgtctggtgtaccgcgctctctcg

SEQ ID NO: 28799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccacagggacattcacggttttttttgg

SEQ ID NO: 28800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccaccgtttctcgatctcgcacccaggt

SEQ ID NO: 28801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccacgttcgagtgcttgttcgtactcac

SEQ ID NO: 28802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccagcccccgacgcattagcccgggaat

SEQ ID NO: 28803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccatccacatccgttactacgcgctcaa

SEQ ID NO: 28804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacccaccccatagtaacttgaagtgcacg

SEQ ID NO: 28805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccccgagccttcgttctacattatgcgt

SEQ ID NO: 28806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccgaaaaacgtcgtggtacgctcctgtt

SEQ ID NO: 28807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccgagcacggcacccacattacaacagc

SEQ ID NO: 28808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccgaggccaaacgcggtgtgcttggggc

SEQ ID NO: 28809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccgaggtcagactcatgtgcagtatcca

SEQ ID NO: 28810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccgagttgaaagtcatgcttttaggacc

SEQ ID NO: 28811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccgatcaggattgcaatctgcgttttgc

SEQ ID NO: 28812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccgcaacatactaacatccgtctgtgta

SEQ ID NO: 28813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccgcacattcttcgtgtacggtaagcac

SEQ ID NO: 28814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccggagaatggacaagcgtattgccacg

SEQ ID NO: 28815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccggtatgattggtctggaagtcaagcg

SEQ ID NO: 28816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccggtccatcagtgcgcgcaggggttct

SEQ ID NO: 28817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccggtgtgcgtattgacctgtcgtcgcg

SEQ ID NO: 28818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccggttgttggtcgttcttttccggtct

SEQ ID NO: 28819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccgtggcgtgttggaaaccgcgggcgtc

SEQ ID NO: 28820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccgttgctttctacccatccgtgtgagc

SEQ ID NO: 28821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacctatggtgcggtgagcgcaaccccgac

SEQ ID NO: 28822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacctcgaactcacatggtgatacatactt

SEQ ID NO: 28823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacctcgtatgtggggatggttgaggtgtg

SEQ ID NO: 28824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaccttacaaagtcgttttgcaggccgatc

SEQ ID NO: 28825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgaaaatgctcgccagaattcaggcgtg

SEQ ID NO: 28826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgaaactttttgagcgcgagtcagcgga

SEQ ID NO: 28827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgaaatgaagggttgcaactcagcgggc

SEQ ID NO: 28828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgaacgagcaacgaggggctgcacacgc

SEQ ID NO: 28829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgaaggatcgcgataccaatctaccatt

SEQ ID NO: 28830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgacacgctttcacacggaagccatgct

SEQ ID NO: 28831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgacccattagttcgtggcctacagtcg

SEQ ID NO: 28832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgacttccatggttatctcgtcgcgatg

SEQ ID NO: 28833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgagggtaagcagtctgcggggaacggc

SEQ ID NO: 28834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgagtggatgggggccatggagggcaac

SEQ ID NO: 28835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgatcaggctcgcggtaggaatcggagt

SEQ ID NO: 28836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgatgcgatagctatgcagcttttgctt

SEQ ID NO: 28837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgcaaacaatgcgaaacacagcctggtg

SEQ ID NO: 28838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgcaataaggaatatcaaggtgacctag

SEQ ID NO: 28839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgcatgaacgctatggtggtagcgacgc

SEQ ID NO: 28840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgccgcggtgctgtgggacgtgctaacg

SEQ ID NO: 28841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgcgcaggtaagttgattcgaggaagcg

SEQ ID NO: 28842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgctccagataaaggcgggtcccactaa

SEQ ID NO: 28843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgctttcgttagcctacgggtacccccg

SEQ ID NO: 28844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacggaaattgattccgcgagttcggttcc

SEQ ID NO: 28845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacggaatatcccactatgtatcagtcttc

SEQ ID NO: 28846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacggatcagcgaggacaattccttgcaac

SEQ ID NO: 28847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacggcacgactagtagttatccacccggg

SEQ ID NO: 28848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacggcatccggcgtgcagaccttgttcgc

SEQ ID NO: 28849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacggcgtgatctaacgggcgatgaccaca

SEQ ID NO: 28850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgggaacactcgtcagacgcaccctctg

SEQ ID NO: 28851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgggagcgcgtcactcataacgattctt

SEQ ID NO: 28852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgggatgggaggcaagttcccgccgagc

SEQ ID NO: 28853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacggggtggggtgtaaagttggtggagtt

SEQ ID NO: 28854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgggtgcggacatccagaatcgtcgtac

SEQ ID NO: 28855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacggtttctcgacgtgtagagggccagtg

SEQ ID NO: 28856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgtatgttcggagttcgcttggctagcg

SEQ ID NO: 28857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgtatttaggcacaaaaatatagggact

SEQ ID NO: 28858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgtctacgtattttctgtgttagttcga

SEQ ID NO: 28859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgtgcagccaacaattattgcgctcctc

SEQ ID NO: 28860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgtggtcccgtgattccagtgcttgctc

SEQ ID NO: 28861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgtggtgtctcgtctgttaggcggcgtt

SEQ ID NO: 28862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgtgtaacccagttttcgaccagcgctg

SEQ ID NO: 28863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgtgtaggaactaatgacttgcccgttg

SEQ ID NO: 28864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgttagaggctgtttgtaagactgcatg

SEQ ID NO: 28865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgttcagatttaccccgctgcctgatta

SEQ ID NO: 28866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgtttaggtattccgaccacccgggcgg

SEQ ID NO: 28867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacgtttgatggcttatagtcgttgcgcac

SEQ ID NO: 28868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactaaattgtagcgccacagctaagcgct

SEQ ID NO: 28869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactaacgaaattcccgcgcacgcttgtaa

SEQ ID NO: 28870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactaacgggtgggaagcctggcatcatac

SEQ ID NO: 28871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactaagagcgctcaataaggtagggcgta

SEQ ID NO: 28872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactaatcggcgcgtgcatgctgtttgcgg

SEQ ID NO: 28873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactacgcggtatcgcattgactgactcta

SEQ ID NO: 28874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactagccaggcccaccgagactcagaccg

SEQ ID NO: 28875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactagcgcgtgtcgggataggggtgactg

SEQ ID NO: 28876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactaggcaaatgcaacagttctcctgcgt

SEQ ID NO: 28877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactagggaggaagaaccgacgcatatgtg

SEQ ID NO: 28878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactatctctctgtcacatgaccctgcggg

SEQ ID NO: 28879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactcagtagagccaggagtgctggtgcgc

SEQ ID NO: 28880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactcatgccatgtccttggagcaactaat

SEQ ID NO: 28881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactccaaggggatcttttcctatgtccac

SEQ ID NO: 28882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactcgccaaggcaagtacaatagctcccc

SEQ ID NO: 28883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactcgcttgacgatcagaggttgcgtgga

SEQ ID NO: 28884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactcggggcggcataccggagtcacactg

SEQ ID NO: 28885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactcgtcgagcaccggggtctgctgtgac

SEQ ID NO: 28886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactctaagttgttttagggcgcggatcgg

SEQ ID NO: 28887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactctatgtggggcttatcagtttggtgt

SEQ ID NO: 28888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactgacttcaagcaagcatcaatgaaccg

SEQ ID NO: 28889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactgagatcgggaggtatggcttaccggt

SEQ ID NO: 28890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactgcccctctgtacatcggttgatccgc

SEQ ID NO: 28891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactgggtgtatctcgaatagttcccggat

SEQ ID NO: 28892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactgggttatggcgagaacgttcaagctc

SEQ ID NO: 28893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactgtcacatatcacaggcatgtcgccac

SEQ ID NO: 28894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactgtgcgctatgttgtcgtgtgcggtgg

SEQ ID NO: 28895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacttaaacttgaattccccacgtgactcg

SEQ ID NO: 28896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacttacgttagatctttgccttgccaatc

SEQ ID NO: 28897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacttaggttcaagacaatggtttgggcgt

SEQ ID NO: 28898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacttgcgcgtagggatgttctgagtcggg

SEQ ID NO: 28899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacttggattctgtaaatagactcctcgac

SEQ ID NO: 28900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacttggcttttccagaccaccaatactgg

SEQ ID NO: 28901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacttgtggcgagaatgagggcagtgtgtt

SEQ ID NO: 28902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactttaccagaatcgccggagggaaaccc

SEQ ID NO: 28903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactttcgtgtaaccagaagttcctcgtga

SEQ ID NO: 28904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggactttgcgacggaccccattagatgtggt

SEQ ID NO: 28905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggacttttgacaagttttgtctattgtacat

SEQ ID NO: 28906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagaaggctgcacggactgctcgtttctag

SEQ ID NO: 28907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagaccaggagatttgcggttatacctcgt

SEQ ID NO: 28908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagaccgtggctcagggcgagaccgggccg

SEQ ID NO: 28909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagacgaactaaatgcccccgcatgttgaa

SEQ ID NO: 28910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagacgaattgtgttacgcgtcgactgatg

SEQ ID NO: 28911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagagaggtggcgtaacagaacttcgcaat

SEQ ID NO: 28912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagagcgacaggagaagtctgggagtcgtc

SEQ ID NO: 28913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagagcgctagattcggttccactcagttc

SEQ ID NO: 28914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagagcggtattcaacctttcagtagaata

SEQ ID NO: 28915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagagcggtgtcggcgggttatttctggta

SEQ ID NO: 28916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagaggaggacacaggtctgttaaaagcgc

SEQ ID NO: 28917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagaggcaacgtaacaggctgttcaagcgg

SEQ ID NO: 28918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagaggcacggagcggacccaaccagtgtt

SEQ ID NO: 28919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagagggtcggctccaatcggtggtttgct

SEQ ID NO: 28920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagaggttttggaatcctggtagcgcatga

SEQ ID NO: 28921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagagtcggacggttgggacttgcagagct

SEQ ID NO: 28922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagagtttcctcgttgttgtccttttctga

SEQ ID NO: 28923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagatagccggacacagggctacctaacgc

SEQ ID NO: 28924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagataggaatttgtcctaggagtagatat

SEQ ID NO: 28925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagatcagccttgcttggttatcactccgg

SEQ ID NO: 28926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagatcgccaggaagacaggcgcaacacgc

SEQ ID NO: 28927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagatcggatgcgcgtcgcaatgcgttctg

SEQ ID NO: 28928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagcaaacggaatcgtgtctccttccgtgt

SEQ ID NO: 28929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagcaataagggccgttcatgtcaaaaccg

SEQ ID NO: 28930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagcagatgaaccgcatggacccgttgctg

SEQ ID NO: 28931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagcaggggcgagttgttgtgcgggggtgg

SEQ ID NO: 28932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagcagttcgtcaacggcgggctaagtctg

SEQ ID NO: 28933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagcataggcactccgcaaggcccatagcg

SEQ ID NO: 28934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagcattagcggtactgcccgggacgtgtg

SEQ ID NO: 28935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagccgggtccgtgggatctatctcgggtg

SEQ ID NO: 28936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagcctccgcttatcgactccatcaagcgt

SEQ ID NO: 28937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagcgacagtacggtaatacggttcgttct

SEQ ID NO: 28938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagcgctggttgaggctacctgaggccgcg

SEQ ID NO: 28939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagcggttactgtattcggtgctccaaatc

SEQ ID NO: 28940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagcgtcgtctttactggcggcccgttgac

SEQ ID NO: 28941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagcgtggtacggacggcgcatgcccgcgg

SEQ ID NO: 28942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagcgtgtcggggggggagttgtgacagct

SEQ ID NO: 28943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagctagctggttatgcgcttgccgccgtt

SEQ ID NO: 28944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagctaggtgcaggaagactagtcattttc

SEQ ID NO: 28945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagctatgcctcgtacgtaaccgagtcaag

SEQ ID NO: 28946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagctcaagccgcgaccattcttttaggcg

SEQ ID NO: 28947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagctgcgaaactcttctcgtctcgcccct

SEQ ID NO: 28948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagctggcgagctttggtatcccgaagagc

SEQ ID NO: 28949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagctgtggccggttgatcacaaagcgtga

SEQ ID NO: 28950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagctgtgttgaactcctgcatggggcctc

SEQ ID NO: 28951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagcttaactgatggggtttctcacgcacg

SEQ ID NO: 28952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagcttcctggtgatgccctgcgccatcta

SEQ ID NO: 28953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagcttgaccaggtgccgcgaaacgtctgg

SEQ ID NO: 28954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggaaagacacaagtgcggtgtaggtgtc

SEQ ID NO: 28955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggaaagcgcgtagtatgaatcagtatta

SEQ ID NO: 28956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggaaagtttcgtggtgcctaaacatttg

SEQ ID NO: 28957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggacagggtcggcaggggtttgtggagt

SEQ ID NO: 28958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggagattgacatgatcgtaaggcgtcca

SEQ ID NO: 28959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggagattggtttgcgagtaagtatctct

SEQ ID NO: 28960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggagctatgttatcctcgtcaggcacgg

SEQ ID NO: 28961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggaggcggaatggtgcatgctcgtctcg

SEQ ID NO: 28962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggataaaaatcgggttcagttcggtggc

SEQ ID NO: 28963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggatagttaccagcacatcagcggcttt

SEQ ID NO: 28964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggatattggttcaggggtctcccttcgc

SEQ ID NO: 28965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggattaagatcgcctccagtacgagggt

SEQ ID NO: 28966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggcaattcgggctagtgtctcacatgaa

SEQ ID NO: 28967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggcacacagggttgtaacttgagtcgcg

SEQ ID NO: 28968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggcacctgttgcgaggcaatttaagttg

SEQ ID NO: 28969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggcagatcaggagactcccggtcggatc

SEQ ID NO: 28970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggcataatgttcctggtccagccgcgca

SEQ ID NO: 28971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggcccggaacgcatcaccacgcttgcat

SEQ ID NO: 28972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggcgaactgtggggcattgggcatcatg

SEQ ID NO: 28973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggcgagtataagtttaaaacgtgtgacg

SEQ ID NO: 28974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggcgatgagtggttatcatgggttaggt

SEQ ID NO: 28975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggcggctacgcatatctggattgcggtt

SEQ ID NO: 28976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggcggtcagatgggggtctggaatctct

SEQ ID NO: 28977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggcggtcgacggttagggtggtgagacg

SEQ ID NO: 28978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggcttactcagagtcacatacgggttgc

SEQ ID NO: 28979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggcttgtctacctggtactttgagtgac

SEQ ID NO: 28980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagggacggggtagaactgacctggtattc

SEQ ID NO: 28981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagggccgacggtgctgttgacttttcagt

SEQ ID NO: 28982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagggccgggcccggaaatggcttcgtgac

SEQ ID NO: 28983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagggcggtctcgagttcgtgtcggcggag

SEQ ID NO: 28984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagggcgtggatccggttcggggctcggtt

SEQ ID NO: 28985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagggctcaacctgccggggcgatatgggt

SEQ ID NO: 28986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagggctcggaaccggctgaatccttggac

SEQ ID NO: 28987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagggggggggaacgccagtccaacgaccc

SEQ ID NO: 28988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggggtgcaagccggtctcgtagtaagat

SEQ ID NO: 28989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagggtagacctacggcaccttgcgacacg

SEQ ID NO: 28990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagggtgaggtaacaagatcggttacaatg

SEQ ID NO: 28991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagggtgagtgttcaaactactgcctgtcc

SEQ ID NO: 28992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggtaaccacgtcgtaaaagattcggcta

SEQ ID NO: 28993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggtctggtggtctcgcgtcgtaatcgcg

SEQ ID NO: 28994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggtctgtgtaatttgtcgttaacgtcgt

SEQ ID NO: 28995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggtgagaacgccagaccctctttagtag

SEQ ID NO: 28996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggtgaggcaaaattctggttttaagggt

SEQ ID NO: 28997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggtgcctgcctggtagcgaggttagcat

SEQ ID NO: 28998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggtgcggcttcgtagttctggtggactc

SEQ ID NO: 28999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggtgtccttacggcgtcccgtacctcca

SEQ ID NO: 29000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggtgtgatgtaggggttcttgcgtgttc

SEQ ID NO: 29001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggttaagctaaccgggtttcgcctggct

SEQ ID NO: 29002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggttcactgggccagtcgcgcagtccac

SEQ ID NO: 29003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggttgagggggggcgattattttgtccc

SEQ ID NO: 29004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggttggccgcgagctagctttctcgtac

SEQ ID NO: 29005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggttggtgatgacccggaccctcgcgcg

SEQ ID NO: 29006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggaggttgtcagctcgagtaaggctagcgtg

SEQ ID NO: 29007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagtaaggctcaatcgccgacatcagtggg

SEQ ID NO: 29008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagtactctcggtgtgatgcgtggatacgg

SEQ ID NO: 29009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagtagtagagatggtgtcctggatgcact

SEQ ID NO: 29010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagtccagccgagttatttcgctccacagt

SEQ ID NO: 29011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagtcgcaaattgtgtcaggggtggttagg

SEQ ID NO: 29012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagtctaggaaggatccgagcaacaggggg

SEQ ID NO: 29013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagtctcgccccacggccagcgggcagacg

SEQ ID NO: 29014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagtctgggttgccgggccaaacgtaccaa

SEQ ID NO: 29015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagtgacggtgggacccgacgtaagttgtg

SEQ ID NO: 29016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagtgatgattaaaccggtgggcagctctc

SEQ ID NO: 29017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagtgcggttaacgtcggttttgtgtccgc

SEQ ID NO: 29018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagtggaagcgctgcattgccctcgtacgg

SEQ ID NO: 29019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagtggcagacggagtcgctgaggtcgggg

SEQ ID NO: 29020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagtgggttccgcgatagtcgcatatgtac

SEQ ID NO: 29021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagtgtaagaacggggcgagtagcagggta

SEQ ID NO: 29022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagttgaaacgtccgatgcttttatgactt

SEQ ID NO: 29023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagttgttatctaatgccaacgtggccgga

SEQ ID NO: 29024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggagttttacatactctgttttacttcgctg

SEQ ID NO: 29025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggataaacacgaagcatggtttgcggtcgag

SEQ ID NO: 29026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggataacgttacgtgtttgtgagtcaagccg

SEQ ID NO: 29027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggataactaagctcatccagcgctgcggacc

SEQ ID NO: 29028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggataagcttggatactttgaggttatggtg

SEQ ID NO: 29029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggataccaatggtttggcgtgtggcgtaacc

SEQ ID NO: 29030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggataccactgacatagttcattggggctga

SEQ ID NO: 29031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatacccgtatttgatggtatttggtgccc

SEQ ID NO: 29032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatactcattctggtgatcgttaactgacc

SEQ ID NO: 29033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatagccggcttgaggagtttgcgggatac

SEQ ID NO: 29034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatagccgggcattgatgtacacgcctcgg

SEQ ID NO: 29035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatagccggtgtattcgcataccgggtctg

SEQ ID NO: 29036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatagcgggtccgaggctctgtctacgcgt

SEQ ID NO: 29037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatagcgtcattagcctcagggggcgacgt

SEQ ID NO: 29038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggataggagactcgtgtggggggatctcctc

SEQ ID NO: 29039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggataggggcccaggacgattgacgactagc

SEQ ID NO: 29040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatagtaggtcgatgtagtctcgccgcaaa

SEQ ID NO: 29041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatagtccattcgatcaacgggaccgcaat

SEQ ID NO: 29042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatagttaacgattgctcgcaatcacgagt

SEQ ID NO: 29043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatataaggaataatgcgctccgatgttgg

SEQ ID NO: 29044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatatcacggcttggcggtatcggccactc

SEQ ID NO: 29045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatatgcattgggatgtttgtgcctcgtga

SEQ ID NO: 29046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatattatattgacaaccttgcagatcgtt

SEQ ID NO: 29047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatattctcgtcgccacgcacagacggtct

SEQ ID NO: 29048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatattgcttgcagcctggtattaattctt

SEQ ID NO: 29049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatcaaaagtcatccctttagacttggcct

SEQ ID NO: 29050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatcacatggattagcgacatcgtcctctt

SEQ ID NO: 29051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatcacccacacatatgactgtattcgagg

SEQ ID NO: 29052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatcaccgtggcggcctgtaggcttaggtc

SEQ ID NO: 29053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatcaggtgcggcggtgcagggaactgtgc

SEQ ID NO: 29054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatcataccctggttcattgttccatggcc

SEQ ID NO: 29055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatcatagcggagtcggagttcattaatca

SEQ ID NO: 29056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatcatcgacgtaaggcactagccggccta

SEQ ID NO: 29057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatcatgggagacgcggaccttttatgcct

SEQ ID NO: 29058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatcatgtatatcgtctcaccacaccgtgc

SEQ ID NO: 29059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatccagaatgctggctaactcggtatccg

SEQ ID NO: 29060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatccagactgtcaatcagcgccggggtta

SEQ ID NO: 29061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatcccgggggccagggaagcgtcctggga

SEQ ID NO: 29062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatccggaatgtccagtcgccaccctgcgg

SEQ ID NO: 29063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatccggacggcgcactgcgaatttcgtcg

SEQ ID NO: 29064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatcctgaacctcgtcattgaagctccatc

SEQ ID NO: 29065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatcctggatgggcaattacatgattaagg

SEQ ID NO: 29066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatcgcacaaatgtataccggcattgaggg

SEQ ID NO: 29067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatcgcggaattgcgggaattgggaaatgg

SEQ ID NO: 29068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatctcaacaggtaaggttcaagtaccgcg

SEQ ID NO: 29069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatctccctacgtagggtcgtctggggctt

SEQ ID NO: 29070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatctggataggcaggaagatggttggacc

SEQ ID NO: 29071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatctggcggaacagaagttcatattacgt

SEQ ID NO: 29072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatcttgcagggggcaaaggcgtcccctgg

SEQ ID NO: 29073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgaaatacaatagttgaactacgctgtt

SEQ ID NO: 29074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgacacgtcaaactaggtcaaatgcttc

SEQ ID NO: 29075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgacgaggcatagttcgtggcctttgcg

SEQ ID NO: 29076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgacgctgggaggagtgcggttgccaca

SEQ ID NO: 29077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgagacggtttttggtgcgagaatttca

SEQ ID NO: 29078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgagcgtgggtatctttgtgcattagct

SEQ ID NO: 29079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgcagacgggtgcccgttacggacagtg

SEQ ID NO: 29080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgcccacacacctcatcttggcgggggg

SEQ ID NO: 29081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgcccggtcattcccgtcttcgttatcg

SEQ ID NO: 29082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgccggtgcacgttgggcaacgtagggc

SEQ ID NO: 29083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgcctggttcggctaatcccagtgtcta

SEQ ID NO: 29084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgcgcatgtatatgcatacggaggtatt

SEQ ID NO: 29085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgcgggcaattttgcaggcacaggggcg

SEQ ID NO: 29086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgcgggccgggatgtgcgatgttcttgc

SEQ ID NO: 29087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgctgtgctgcatgtttctgccatcaag

SEQ ID NO: 29088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatggacgccgcatgccagtcatcactggg

SEQ ID NO: 29089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatggactgcatgggctacacttgcggcgc

SEQ ID NO: 29090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatggccggcgtgcacccgatgagttctgc

SEQ ID NO: 29091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatggggactagtacgacctgattccggca

SEQ ID NO: 29092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatggggccagcaacgacgcggttaccctg

SEQ ID NO: 29093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatggtatgtgaaggtttcacttgcgctag

SEQ ID NO: 29094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatggtatgttcggggcgatgatgatcgtt

SEQ ID NO: 29095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatggtcagcagtggtggtcccttgaaccg

SEQ ID NO: 29096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatggttccttttcgtttttttagtactaa

SEQ ID NO: 29097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgtaggcgacttctcacggggttcacgc

SEQ ID NO: 29098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgtggcgtgtaaccgatgctggctcggg

SEQ ID NO: 29099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgttatgcaaggtgagtggtcggaactg

SEQ ID NO: 29100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgttctgcgggcctggtcatctccaaat

SEQ ID NO: 29101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgttggtgcgctgagaacgccgttatta

SEQ ID NO: 29102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatgttttgtctgatatttttcgacgtgtc

SEQ ID NO: 29103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggattaagaagtccacgactccacggctttg

SEQ ID NO: 29104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggattacgctcaagtagacgcgatgcggttt

SEQ ID NO: 29105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggattaggagcccctatagtcgcaccaacat

SEQ ID NO: 29106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggattcagccaacttaatgccgggggttctg

SEQ ID NO: 29107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggattcatgacgagagagtgtcgtccgtagg

SEQ ID NO: 29108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggattcggccgttgattccggggtgggggct

SEQ ID NO: 29109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggattggaccaagagaggttgcttgtacggg

SEQ ID NO: 29110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggattgggcacgcgcttagcccgcggctaca

SEQ ID NO: 29111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggattgtgtgcaaaggctgacccgatcccgt

SEQ ID NO: 29112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatttaccgctgaaagagacaaaacgaggc

SEQ ID NO: 29113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatttcagctgccgcgggcgagtggtttct

SEQ ID NO: 29114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatttcaggatccgaagttggttgtttatc

SEQ ID NO: 29115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatttcatggtttaatctccgctgctcgga

SEQ ID NO: 29116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggatttgtggcgtagtgtggttggtatggtg

SEQ ID NO: 29117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaaaaggaacggggacgcagcgagctgtg

SEQ ID NO: 29118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaaacggaagctctagactggatcatcgc

SEQ ID NO: 29119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaaatcgggttccgcagtagtggacacgg

SEQ ID NO: 29120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaaatgggtaaagaaagtccgctatgggg

SEQ ID NO: 29121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaacaacgaggcaacctatccgcgctccg

SEQ ID NO: 29122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaacattgtgccactctggttaatgtcga

SEQ ID NO: 29123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaacccaaactccgatatcgacacactaa

SEQ ID NO: 29124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaaccctatggaatgtttatagctcgggc

SEQ ID NO: 29125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaacgacgtgaccgttaggggagggtatc

SEQ ID NO: 29126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaacgacgtgctcgcgctcctcggtttgt

SEQ ID NO: 29127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaacgcgcagtggtgagattggtcacacg

SEQ ID NO: 29128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaacgtactccggccctcgcaagctgctg

SEQ ID NO: 29129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaacgtgaatgcctgtcaacttgactaat

SEQ ID NO: 29130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaactgggtccaggtggtaatgcgtggtt

SEQ ID NO: 29131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaagacaagaagcaggtagatgacgagca

SEQ ID NO: 29132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaagagtagttgggtcgatccgactcagg

SEQ ID NO: 29133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaagcatattccatggagaagcacgaatt

SEQ ID NO: 29134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaagcatctttaaacttcggagttcagtc

SEQ ID NO: 29135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaagcgggtcgatcgtttctggcgtaaag

SEQ ID NO: 29136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaagctttctcataatcgcggaacatacc

SEQ ID NO: 29137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaagggggaagccatgaatgcattgaacc

SEQ ID NO: 29138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaaggttttccacgactgagctttcgtcg

SEQ ID NO: 29139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaagtacgagaccgttagcaatctacagg

SEQ ID NO: 29140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaagtcagtacatggggctaaagggctac

SEQ ID NO: 29141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaagtggaagtataatgggccctgctcgg

SEQ ID NO: 29142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaatcagtcccggctgaattcaggttagt

SEQ ID NO: 29143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaatcggagtgcgatctcacacaaacata

SEQ ID NO: 29144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaatgacgacgcggttgggttggtctcgc

SEQ ID NO: 29145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaatgatcaccacgtcccatcagtctcga

SEQ ID NO: 29146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacaaaacccaatatgggttgatttgagg

SEQ ID NO: 29147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacaatgtcaatctcattttcgcgagtcc

SEQ ID NO: 29148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacacaggcgtcctgcgcgatgacagtac

SEQ ID NO: 29149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacacgaacaaggacgcgaaaggggcgtg

SEQ ID NO: 29150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacacgcaatagcggtttccctaaatcgt

SEQ ID NO: 29151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacacgggcttggatccgagccccttccg

SEQ ID NO: 29152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacactatgacgtgtaggctgatctcacg

SEQ ID NO: 29153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacactcaagatgcggagacttttacacg

SEQ ID NO: 29154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacagaggcgcatgttattaggctgagcg

SEQ ID NO: 29155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacaggtctactaacgcgataccgaacgg

SEQ ID NO: 29156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacatgcatctccggggtcaggaggatga

SEQ ID NO: 29157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaccaagatggttcataactggttcgtac

SEQ ID NO: 29158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaccccgcgaacaccactcctagtgaccg

SEQ ID NO: 29159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaccctgagtcgacctacacagttcgctt

SEQ ID NO: 29160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaccgagactgtctgtgtaatcttcagtg

SEQ ID NO: 29161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaccgcgtaatagcgcacataaaaatgcc

SEQ ID NO: 29162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaccggctcattcacgctgggtgtagggc

SEQ ID NO: 29163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaccgtacgaggtaactgcttcgtgcgtg

SEQ ID NO: 29164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaccgtaggacaggatgtaatccatgtca

SEQ ID NO: 29165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaccgtgtgtttagctgttcgccaatcgg

SEQ ID NO: 29166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacctaatacattgatacatacttcgctc

SEQ ID NO: 29167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacctacctctgttacctgacatgaaggg

SEQ ID NO: 29168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacctagcaaactttatgttctcgagacg

SEQ ID NO: 29169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacgatgtgagccattactgcgcgttgat

SEQ ID NO: 29170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacgcagcactattgtatatcgaatgctg

SEQ ID NO: 29171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacgcatgtcctttcatattgcgtacccg

SEQ ID NO: 29172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacgcgcgtgtgttgctggtatgggcgta

SEQ ID NO: 29173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacggatgacaggctgctggggcggaggg

SEQ ID NO: 29174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacggctgaaccaacttaaccgacgtgga

SEQ ID NO: 29175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacgggtaagatcttctgttgtccccctt

SEQ ID NO: 29176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacggtcgcatggtcaggaagctggtcgc

SEQ ID NO: 29177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacgttaatagtggtgagattttcttcgc

SEQ ID NO: 29178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcacgttatgctacctaggcgccaataccg

SEQ ID NO: 29179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcactaggtgtgtttgccaaagcggcgtga

SEQ ID NO: 29180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcactcagcagggttagagctctatcccta

SEQ ID NO: 29181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcactcgaaggtcaggaaaagttcgcccgc

SEQ ID NO: 29182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcactcgtcgatccaaccgtcccagtcgtg

SEQ ID NO: 29183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcactgctcggaattgacgcgggccatcgg

SEQ ID NO: 29184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcactggctccagcatggctaccctgttct

SEQ ID NO: 29185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagaaaatcggagtgccattgtgctcacg

SEQ ID NO: 29186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagacgcgtagctttgactggaaacgagt

SEQ ID NO: 29187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagacgtggcattggtcgggggcagcgag

SEQ ID NO: 29188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagactactgggcacacagggggtttggt

SEQ ID NO: 29189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagagattagtgacgtacgtgtcacatgt

SEQ ID NO: 29190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagagccatccacaacgtgagtggacggg

SEQ ID NO: 29191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagaggatgctgattaaagtgccattcac

SEQ ID NO: 29192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagatacgagctacgtcagacagtatagc

SEQ ID NO: 29193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagatcacgttggactttccagtgacccg

SEQ ID NO: 29194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagcataaactcccatgtacgcgtggcgg

SEQ ID NO: 29195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagcccggcattcgcgtacacttcggtaa

SEQ ID NO: 29196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagccgtacggacctcatatggttcgttg

SEQ ID NO: 29197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagcgacgacaagatggggtgacaacgtt

SEQ ID NO: 29198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagcgcgctaccccggaatgaaggggcat

SEQ ID NO: 29199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagcgctgaggttccgctatccggccttc

SEQ ID NO: 29200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagctgttgggtaggaatctgacgcagca

SEQ ID NO: 29201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaggaatgagagctaggcgcatcagcagt

SEQ ID NO: 29202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaggacaatcgtgggaatctttatcgctg

SEQ ID NO: 29203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaggactctgtgggaagcgcggctcgttc

SEQ ID NO: 29204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaggagtaccagattgtcgcaccacgtgg

SEQ ID NO: 29205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaggatctgatgtcagcgtgtttagtgag

SEQ ID NO: 29206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaggcagttgggcgaggtacttgtgtatc

SEQ ID NO: 29207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaggctaattagcgcttgctggagtggta

SEQ ID NO: 29208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagggacgtttcttgacaccaaatctggt

SEQ ID NO: 29209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagggcaagcgggcacactagggccgtac

SEQ ID NO: 29210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagggcaataacactatttgatgagaccg

SEQ ID NO: 29211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagggcgaccaaagttgggtgtcgggtcg

SEQ ID NO: 29212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagggggatagttacgtaatgtgggtagc

SEQ ID NO: 29213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagggtgactgacatcgattggggtgcac

SEQ ID NO: 29214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaggtagcagtttgatgttcatcctggtt

SEQ ID NO: 29215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcaggtgttcggggccggtacggaattggg

SEQ ID NO: 29216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagtgtgttccttgatattgcggacttcg

SEQ ID NO: 29217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcagttaggggtgtctcacgggcggatttg

SEQ ID NO: 29218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcataacggggcctcaggatggactattca

SEQ ID NO: 29219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcataccggtacactcaagcggagttgctg

SEQ ID NO: 29220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatacgagtctgcttccgtcgcagccagc

SEQ ID NO: 29221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatacgcatagagccgacgttctgcgatg

SEQ ID NO: 29222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatagcgtgcggggccttgtcattacgcg

SEQ ID NO: 29223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatatccgtggaccgtctggacttggctc

SEQ ID NO: 29224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatcaggggacatgcaagttggccagcgt

SEQ ID NO: 29225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatcagtgcctgggcttggaatacgctgt

SEQ ID NO: 29226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatccacgcatggacactcgcttatactc

SEQ ID NO: 29227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatcccgctgctcctgttccttgcgagtt

SEQ ID NO: 29228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatccgttacatcgtattttctaataccc

SEQ ID NO: 29229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatcgttaatattaagcaacagttgaaag

SEQ ID NO: 29230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatcgtttcatggtataagtggtctatgc

SEQ ID NO: 29231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatctacgcgcatttaaaactggcagcca

SEQ ID NO: 29232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatctctaattatcacgcgtgtctacatc

SEQ ID NO: 29233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatgaaccataggctgccgctcgttgctt

SEQ ID NO: 29234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatgaacgggcgggcgcagtaaggattta

SEQ ID NO: 29235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatgacgctcttaacttttttggcggttg

SEQ ID NO: 29236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatgcaagtgtggcactggggttctattg

SEQ ID NO: 29237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatgcacgctccgacttactttatgggtg

SEQ ID NO: 29238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatgccagtggagccgatcatgactcgag

SEQ ID NO: 29239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatgcgcgtattgcccgcttcgggtgtgg

SEQ ID NO: 29240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatgcgcttacgcaacatggtcggtggtg

SEQ ID NO: 29241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatgcgttggggcacacttgcttatcggg

SEQ ID NO: 29242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatgctggtaagacactattttgagagct

SEQ ID NO: 29243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatggcgggaggcaatgaggtttacgacg

SEQ ID NO: 29244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatggttcggggccttagggtacaacgct

SEQ ID NO: 29245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatgtaaaggtccggctcaagcgtcgcgg

SEQ ID NO: 29246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatgtacagtagtcggatctcgcgatgtg

SEQ ID NO: 29247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatgtaggagggttattctgtcgccaaat

SEQ ID NO: 29248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatgtcagactggtgcacagttaggttcc

SEQ ID NO: 29249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatgtctccttagacgttatctccgtttg

SEQ ID NO: 29250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcattaggtttccatcgcgctgggatcgat

SEQ ID NO: 29251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcattagtgattcgggaactgctgtacgag

SEQ ID NO: 29252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcattgatgtcttcagaagtcaggcggcgg

SEQ ID NO: 29253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcattggatcgttgagtcccttggtagcgt

SEQ ID NO: 29254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcatttgaatgagtcatcctggaaactttc

SEQ ID NO: 29255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcattttgctccttgcattagcgttggttt

SEQ ID NO: 29256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccaaaacctagtacaggatcgtaaatagc

SEQ ID NO: 29257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccaaattgagtctccatagactggatgct

SEQ ID NO: 29258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccaaccatggggcatcagcgggggcccgc

SEQ ID NO: 29259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccaagcactctgcacgatacacccagcta

SEQ ID NO: 29260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccaagcttggaggcctgtaccgtgagggg

SEQ ID NO: 29261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccaatgctaagagatagagcccccgtctc

SEQ ID NO: 29262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccacacatgcagggcgggtcggatggcgc

SEQ ID NO: 29263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccacacttcgcaacgttagtcgttccatg

SEQ ID NO: 29264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccacaggtgaaggcacggtagcccgcaca

SEQ ID NO: 29265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccacataagcacgttctgttcacgcggtc

SEQ ID NO: 29266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccacatggatgcactaaccactatcggta

SEQ ID NO: 29267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccaccacagactgccaagcatgctccatg

SEQ ID NO: 29268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccaccgtcaatcatggtcgaatgaatagt

SEQ ID NO: 29269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccacgcgcatgtgtaacgtaggaaggctc

SEQ ID NO: 29270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccacggagttcgagcaagggtggcctttc

SEQ ID NO: 29271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccacggctgtgccacacttgtatgtcggt

SEQ ID NO: 29272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccacgggcgggagtttttggatacatcgc

SEQ ID NO: 29273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccactgagtgccgggcacttcaccgtatt

SEQ ID NO: 29274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccacttgcgaactgccagatgttgcagca

SEQ ID NO: 29275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccacttgttcccacaactggggtctcgta

SEQ ID NO: 29276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccagaaagtactcagttgtgtttagtcgt

SEQ ID NO: 29277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccagaacgcacggtgttggaagtcttgcc

SEQ ID NO: 29278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccagagtcaaggtccataggccttcgctg

SEQ ID NO: 29279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccagcgacggtattaattctctgcacagc

SEQ ID NO: 29280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccagcgtaggtcgggtaaagatgacgctc

SEQ ID NO: 29281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccaggcgatgcagttaagatgcactcgcg

SEQ ID NO: 29282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccagtgcggacatgcggaggggtcgggag

SEQ ID NO: 29283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccagttccgtggaacgcacgaaacagctt

SEQ ID NO: 29284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccagtttacacacgtgctccggctcgtac

SEQ ID NO: 29285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccataagaagtaacctgatcgaagggcgc

SEQ ID NO: 29286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccatcctgggcaggcccgtgagaggtggg

SEQ ID NO: 29287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccatcgctgagcggcaccatattggtagg

SEQ ID NO: 29288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccatggctctctcttctggtgtcacgtat

SEQ ID NO: 29289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccatgtcgcgtaagtggttggagcgggtc

SEQ ID NO: 29290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccattaaggttacggttgtatataggtct

SEQ ID NO: 29291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccattacgtgttgagtgcgagcgcggacc

SEQ ID NO: 29292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccattgaattttgtcgagttcggtgggga

SEQ ID NO: 29293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccattgctatggtccaggcaattggcaat

SEQ ID NO: 29294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccattggggtatcgccacacctttttggt

SEQ ID NO: 29295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccaaacccggttccgttcacctttcccg

SEQ ID NO: 29296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccaaagataatccaaagctacatccggc

SEQ ID NO: 29297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccaacagttaccccgccaccatcaccgg

SEQ ID NO: 29298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccacatagaggcgatatgatccggcttc

SEQ ID NO: 29299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccactcacgaatagaccgtaacgttccc

SEQ ID NO: 29300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccacttgaaggcgtccagtgcagggagt

SEQ ID NO: 29301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccatcgcgcgcggaagagtaagctcccc

SEQ ID NO: 29302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccatgggatcaccatcgcgggaccttgt

SEQ ID NO: 29303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccatgtcgaccccaagatgccacaggtg

SEQ ID NO: 29304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccccaaagcgcacataccacagggagatc

SEQ ID NO: 29305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccccccgtctacttaaaggtcgtgatgtg

SEQ ID NO: 29306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccccgagcggcttatgcttgtagcttcgg

SEQ ID NO: 29307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccccgtgcactgttgctgttgtcgctttc

SEQ ID NO: 29308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccctatagaaagtggctccattcaatcc

SEQ ID NO: 29309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccctgatcacggtggattggtctggtcc

SEQ ID NO: 29310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccccttcggacggacgtttgttcatccgg

SEQ ID NO: 29311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccgcggactcgaagaacttctgtatcgg

SEQ ID NO: 29312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccgcgtatgctgacatgcacttttcggc

SEQ ID NO: 29313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccgggcgtagcaaggcgaacatgcgtat

SEQ ID NO: 29314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccgggggtacgaggtgatcttgcgcgga

SEQ ID NO: 29315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccggtcagccagctttgactgaggagtt

SEQ ID NO: 29316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccgtcggcgacgtctccattgtactatc

SEQ ID NO: 29317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccgttagataggcaattgcactgcgtgg

SEQ ID NO: 29318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccctcaggtaacatggacattcatacgct

SEQ ID NO: 29319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccctcatcgagatgcgacgtgtaagtact

SEQ ID NO: 29320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccctccacggctgctacttcttcatcgtg

SEQ ID NO: 29321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccctcccatcttagtcacgctctggcttg

SEQ ID NO: 29322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccctcgatccaaattgtcccacttacaat

SEQ ID NO: 29323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccctgctgtaacgttgatgtctcgcccgt

SEQ ID NO: 29324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccctggcatgcgtgtggtttgcggttgat

SEQ ID NO: 29325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcccttaggctaggaagaggtgttgcttgg

SEQ ID NO: 29326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgaaacgcacaaatgacggggttccatc

SEQ ID NO: 29327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgaccttttcccacgtgcctgtattctg

SEQ ID NO: 29328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgacgttttgggccatgttttgcggcgt

SEQ ID NO: 29329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgactcacgttcaccgttaccttgggtt

SEQ ID NO: 29330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgagatgagaagcgtgcggggtgccgcg

SEQ ID NO: 29331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgagcccacgcgcctcgttgagtatact

SEQ ID NO: 29332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgagtacagttctaagtttgaagcaaga

SEQ ID NO: 29333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgagtagtaatccaacgttggtttcacg

SEQ ID NO: 29334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgatataagcacgtttttggattcgttg

SEQ ID NO: 29335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgatcggacataggtgggggtgggcatg

SEQ ID NO: 29336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgcaacagatacggaggctatcgacgtt

SEQ ID NO: 29337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgcaagcgaaagccaaggtgttcttggt

SEQ ID NO: 29338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgcaatgaactagcaggtacgggcgatg

SEQ ID NO: 29339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgcaggttctttagttagaagtatattt

SEQ ID NO: 29340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgcatgatcgattctcgaagggagaaca

SEQ ID NO: 29341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgcggattcgttgtttctcccgtcgacc

SEQ ID NO: 29342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgcgtaaggggggtaggtccggttgccg

SEQ ID NO: 29343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgctacagatcctgccgtcttttgggct

SEQ ID NO: 29344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgctacgagtatttatggaagctgccac

SEQ ID NO: 29345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgctactttgtgagagcaaggggaccat

SEQ ID NO: 29346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgctccgagcaagtgcaacgcctgcaag

SEQ ID NO: 29347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgctttaggtagcgttggctccgatatt

SEQ ID NO: 29348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccggacaacgtcatgggtttcgtgagagt

SEQ ID NO: 29349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccggacagttaagtatttacgctaacacg

SEQ ID NO: 29350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccggacgtttcgaagtcgcagtacgttcc

SEQ ID NO: 29351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccggaggcagtgcaattggttatgtgtgt

SEQ ID NO: 29352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccggatgggagactgcggcaatctggggt

SEQ ID NO: 29353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccggcagaaagagcactacaaggaggcta

SEQ ID NO: 29354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccggcatgcacactccgactctccaatcg

SEQ ID NO: 29355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccggccagctttcggcggctttctgcgag

SEQ ID NO: 29356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccggctcaggtgtccgattggtcattcgg

SEQ ID NO: 29357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgggcccttcatgcacatttcggttttg

SEQ ID NO: 29358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgggctgtgtttatcgccacaatcgtca

SEQ ID NO: 29359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgggggatttttcgctctctggcccacg

SEQ ID NO: 29360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccggggtacagggctcatgatcgtagcgg

SEQ ID NO: 29361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccggggttcaatcgaactcaaagataccc

SEQ ID NO: 29362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgggtgggactgtccctttcgctgtttg

SEQ ID NO: 29363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccggttgctagcaccgaagtgctcaagca

SEQ ID NO: 29364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgtacaataacccgtgtcctcatttacc

SEQ ID NO: 29365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgtaccaccaatcgtcaaacgaggaatg

SEQ ID NO: 29366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgtcagcccaccccggtggaagtttggg

SEQ ID NO: 29367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgtcgcacactgaggtgacaggtgtcgg

SEQ ID NO: 29368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgtcgtaatccgattgaataacgttccg

SEQ ID NO: 29369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccgttgtgcgtggatgggccggttatcga

SEQ ID NO: 29370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctaaatcggatttcgagtaggttgttgc

SEQ ID NO: 29371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctaacgtgggacaatgtgcagtcctcgt

SEQ ID NO: 29372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctacacccttggacggagaggggtgctg

SEQ ID NO: 29373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctaccagtcgcgcaaccccacctacatc

SEQ ID NO: 29374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctacgaaaaagacgagtcacggtcggag

SEQ ID NO: 29375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctacgtctaattcggcgaatgagtttcc

SEQ ID NO: 29376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctacttgttttcgaatcactggtctcac

SEQ ID NO: 29377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctagcattccagggagtttacaaggcat

SEQ ID NO: 29378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctagttacgtgtaagcgtaaaaggaacc

SEQ ID NO: 29379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctcaactcccttcctgcctgtcctgtgg

SEQ ID NO: 29380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctcaatagcgataccttacgagataatc

SEQ ID NO: 29381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctcatcgtaatgctgcgcactattcccc

SEQ ID NO: 29382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctcgagaatacgcgataccagtacgggg

SEQ ID NO: 29383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctcgcgagggccaacgtccaaggcgggc

SEQ ID NO: 29384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctcggattttggttcggcgtggattggg

SEQ ID NO: 29385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctcggttgtacggtcaacgtctttgtcc

SEQ ID NO: 29386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctctcgcattagcctctcataaataccc

SEQ ID NO: 29387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctgagccaactggtaatgtgatgagcca

SEQ ID NO: 29388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctgcatgtattcctgtcctgccactgtt

SEQ ID NO: 29389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctgcctgttacgagtagctaccccatag

SEQ ID NO: 29390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctggaaggtgccacttcctgattaaacc

SEQ ID NO: 29391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctggagtggcggaaagtcgatggttaac

SEQ ID NO: 29392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctgggacattagtcgacgagatatggct

SEQ ID NO: 29393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctggttaagacattgggattacaggcgt

SEQ ID NO: 29394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctgtagaatgcctcgtcatagcctttgc

SEQ ID NO: 29395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctgtaggagctatactgaggggggtagg

SEQ ID NO: 29396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctgtaggtgtcggtagtagcatactccg

SEQ ID NO: 29397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctgttgcgcatgaaactcctgaacggtc

SEQ ID NO: 29398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccttatagcacggcacacgcgcaccgtct

SEQ ID NO: 29399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccttcaggttatgtgtctctaatgttctt

SEQ ID NO: 29400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccttcgaacactctgtctcagaaaaaccc

SEQ ID NO: 29401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccttctagactctgaggagacaattaatg

SEQ ID NO: 29402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccttgagcgtcgtccggtagaatgcgtac

SEQ ID NO: 29403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccttgatatcagcttacacctgcccgggc

SEQ ID NO: 29404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccttgcatatcaaacagcctgttccgtcg

SEQ ID NO: 29405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggccttgtgacttaacgtatcctgggtcacg

SEQ ID NO: 29406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcctttggtaatgcggcgaccgggtaggcg

SEQ ID NO: 29407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgaaagtgcagagtctgctagaagatggg

SEQ ID NO: 29408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgaacgcatctttctcccgatgcactatg

SEQ ID NO: 29409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgaacgggcctaaatggcgttccttgctg

SEQ ID NO: 29410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgaacgggtaagggtgctcgggatgcctc

SEQ ID NO: 29411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgaaggagccaacagatctaatgagcttt

SEQ ID NO: 29412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgaagggggcgttaagagaagcggccact

SEQ ID NO: 29413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgaatcacctcacatggagggccttaggc

SEQ ID NO: 29414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgaatcgtagtaagcgccgttaccagacc

SEQ ID NO: 29415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgaatgggcacacgtcaggggccaatgct

SEQ ID NO: 29416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgacaccgggaaggcagcaacctaacgct

SEQ ID NO: 29417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgacacggatgttcgataggtggggggcc

SEQ ID NO: 29418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgacagcgctcatatcagcatgtgacaac

SEQ ID NO: 29419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgacatggacaacagtacgcatgggtccc

SEQ ID NO: 29420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgaccccagcgtgcgcactcgagtgtgtg

SEQ ID NO: 29421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgaccggggacaggagcgacaggccactt

SEQ ID NO: 29422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgaccgggggtttctttgttgtgtcaggg

SEQ ID NO: 29423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgacgactactgggcatgtgcggtacctg

SEQ ID NO: 29424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgacgatgggttggcattgagtgtgggat

SEQ ID NO: 29425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgacgcgcggaggttatcatcggacagcg

SEQ ID NO: 29426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgacggtcagctgccgtaggttttcagca

SEQ ID NO: 29427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgactacgcgcgacatccccgaggccccc

SEQ ID NO: 29428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgactccacacgacaacaccgtgttatgg

SEQ ID NO: 29429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgactgaccggaattcctgccgtttgaag

SEQ ID NO: 29430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgactgcatcatagtgtacgttcggagca

SEQ ID NO: 29431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgactttaccgagaggccagcgtcggaag

SEQ ID NO: 29432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgagaaccgcgaggctatcgggccagatt

SEQ ID NO: 29433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgagaacgcagcgtctcctaccacttgat

SEQ ID NO: 29434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgagacacgctgcgcatccccgggtaaaa

SEQ ID NO: 29435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgagcacagctaactccgcggcacgacgt

SEQ ID NO: 29436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgagcggggttttggagcccgtatgtcac

SEQ ID NO: 29437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgaggagtgctgggtttataagttggcca

SEQ ID NO: 29438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgaggcaaacgtaaacagtacatttattc

SEQ ID NO: 29439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgagggctcttgataagacagggggttgc

SEQ ID NO: 29440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgaggttaggccacacttcctcctctccg

SEQ ID NO: 29441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgaggttcatatctgctaggaagcattgt

SEQ ID NO: 29442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgagttgaattaacaactgttcgagtcgt

SEQ ID NO: 29443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgataacttgggatttgcagcaggtaagg

SEQ ID NO: 29444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgatagcactttccactggagggtcgttt

SEQ ID NO: 29445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgatctgtaagtactgcggtagccacggc

SEQ ID NO: 29446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgatggagtaagtggggcaaaccagcatg

SEQ ID NO: 29447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgatggtcaatatggctattcatctcgtc

SEQ ID NO: 29448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgatggtgtgtgcagatgtgctggaagag

SEQ ID NO: 29449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgatgtaccctactgtggccgaaggggtt

SEQ ID NO: 29450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgattagtaacaagcatcgaggcctgtgc

SEQ ID NO: 29451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgattgcaacattgggggtggtcaaggtc

SEQ ID NO: 29452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcaaggtacataactggagcacggtttg

SEQ ID NO: 29453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcaagtgatgtccgcagaacagaccggg

SEQ ID NO: 29454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcaataggggatgaaacccaccgtgggt

SEQ ID NO: 29455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcaatcttaggggttcggtgtcgcggtt

SEQ ID NO: 29456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcacacggaggttcctggggcgtcgtcg

SEQ ID NO: 29457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcaccaaaggatgtctggtacctcgtcg

SEQ ID NO: 29458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcaccacggggagaacgggaaacggtct

SEQ ID NO: 29459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcacccatgatctggtaggttgcagagc

SEQ ID NO: 29460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcacggtggagtctgcatttaccacgct

SEQ ID NO: 29461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcagcattccggggccaacctgaattga

SEQ ID NO: 29462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcagctcggatcggcttgggagggtctg

SEQ ID NO: 29463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcaggtttgagcgcagcttcggggcttc

SEQ ID NO: 29464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcattacgtcctctttggctgtaagatt

SEQ ID NO: 29465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcccctgttgtgtacgtattccacagtt

SEQ ID NO: 29466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcccggcacatgctcgctaaagccatct

SEQ ID NO: 29467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcccgtgtcctaactgagagccaccgcg

SEQ ID NO: 29468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgccggtaaactggcctccttgttcgctg

SEQ ID NO: 29469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcctcaacgttagcttgattgttacgac

SEQ ID NO: 29470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcgaaaggcctcaacggatctctgctcc

SEQ ID NO: 29471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcgactccggaagactctcgttgatcgg

SEQ ID NO: 29472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcgaggctcagcgtggcgtttgacacgg

SEQ ID NO: 29473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcgagggtatctcggagagcattctgtc

SEQ ID NO: 29474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcgatgatagcggaggcaggaggtcggg

SEQ ID NO: 29475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcgcaatttttgttcagattgagtgcac

SEQ ID NO: 29476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcgcctcgatcctgctaactaccaaaca

SEQ ID NO: 29477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcggacagtggagccatcgccctcgtct

SEQ ID NO: 29478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcggagggaatcgtggaggggttaacga

SEQ ID NO: 29479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcgggcgagaagaagtgctgtgccatta

SEQ ID NO: 29480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcggtaagcggatgatcacgccattctg

SEQ ID NO: 29481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcggtaggcgtgctaggcgaactatctg

SEQ ID NO: 29482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcggtagtgctttcgtcacgggaatcct

SEQ ID NO: 29483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcgtacggtcgagtcgcaaggtcaaggg

SEQ ID NO: 29484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcgtcccgtgtactacaagcttttgggg

SEQ ID NO: 29485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcgtggtcagttactcactatgcactac

SEQ ID NO: 29486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcgtgtcaaggcgttggctttttccctc

SEQ ID NO: 29487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcgttagcagcatcacccatccgtaatg

SEQ ID NO: 29488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcgttgcgagcgagcgatggaaatggca

SEQ ID NO: 29489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgctagacctttaccggtatctgccccgt

SEQ ID NO: 29490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgctagcgtccgaagttaccggatcgggg

SEQ ID NO: 29491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgctatcggggctaccttgtcggcggtag

SEQ ID NO: 29492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgctgcaattaaggtatgtcgggcaacga

SEQ ID NO: 29493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgctgtgaattcatccctcaatcagtggg

SEQ ID NO: 29494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgctgttcgtttcccggaacgcatgtgcg

SEQ ID NO: 29495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgcttacatcagtcggtacgggcgtaagg

SEQ ID NO: 29496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggaaattgcatactgctagatattaggc

SEQ ID NO: 29497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggaactgaacgcagggcgaagcgtaggt

SEQ ID NO: 29498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggaagagcacaagacagtgtgttagggt

SEQ ID NO: 29499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggaagtaatctcctccatttggtagtac

SEQ ID NO: 29500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggacacccgagccctttccgtgcaatac

SEQ ID NO: 29501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggacacgagcacctttgcttgtcagcta

SEQ ID NO: 29502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggacctctcctgtgcattaccgcttgct

SEQ ID NO: 29503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggagattcagcatacaggccgtcgtgat

SEQ ID NO: 29504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggagcggactctacttcgcgggacgagt

SEQ ID NO: 29505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggaggaagagccagatcaccccaggaac

SEQ ID NO: 29506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggaggagcacaatcgagaaactcgttcg

SEQ ID NO: 29507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggaggcggcggagttcgtcagacttgtg

SEQ ID NO: 29508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggaggtccgatcctaggggcttagctcc

SEQ ID NO: 29509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggagtagagtatgttcggggagaggggt

SEQ ID NO: 29510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggatcggttgtgtccagtactcacggcg

SEQ ID NO: 29511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggatgtgaaatatgggtttagtttgggt

SEQ ID NO: 29512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggcaaagtaaggacgacgggggtgcttg

SEQ ID NO: 29513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggcaccggaccatgaacttacccgtcgg

SEQ ID NO: 29514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggcaggcgtacttggatcccggcattgc

SEQ ID NO: 29515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggccacagaactttggggcagtgtgtca

SEQ ID NO: 29516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggccaggattctgatcggaaaattccgt

SEQ ID NO: 29517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggccatagcttacgacgatctgtgcgtg

SEQ ID NO: 29518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggccgcatgcacaccttctcgcgctgtt

SEQ ID NO: 29519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggccggggaggtgcaaggggaggaaatg

SEQ ID NO: 29520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggcggccaagataccgggagaccgtgct

SEQ ID NO: 29521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggcgtggacgtgaaaaaggactcatgtg

SEQ ID NO: 29522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggcgttaatagtgcgcagagggacggtg

SEQ ID NO: 29523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggctaagaatgaggaggtcagctcgatg

SEQ ID NO: 29524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggctcacttcggacgctaactttgacgg

SEQ ID NO: 29525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggctttgagacggcatgttagggactcg

SEQ ID NO: 29526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggctttggtatggtgcgaactatcatgg

SEQ ID NO: 29527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgggaaggctaataccttatgacgtgagc

SEQ ID NO: 29528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgggatgcgcagtatccatggtctgtgtg

SEQ ID NO: 29529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgggcacgagtatagattatgtatgcacg

SEQ ID NO: 29530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgggcaggggtccacgcgatgatggtcta

SEQ ID NO: 29531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgggcgggaggtgtaagtgccagggctac

SEQ ID NO: 29532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgggcgtggtgaatttaggttgttcaggt

SEQ ID NO: 29533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggggaaagggcggttcaaacaggtttcg

SEQ ID NO: 29534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgggggtaatcggtctcgcgatacgaaac

SEQ ID NO: 29535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggggtgacacgggttgcccgtattgttg

SEQ ID NO: 29536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgggtaggcgtctagtggtcactagcggt

SEQ ID NO: 29537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgggtcggcacaacggtctaaaacgcacg

SEQ ID NO: 29538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgggtcgggttatcggtctcgttggtatg

SEQ ID NO: 29539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgggtgcttggttaaccgttctgggatgt

SEQ ID NO: 29540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgggtgctttatcagttgtaccccgttgg

SEQ ID NO: 29541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgggtttcttggacggttccgcggtgtcc

SEQ ID NO: 29542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggtaagacggctcgaccccggaaggctc

SEQ ID NO: 29543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggtagtgtcagatggtaaagaaacgtcc

SEQ ID NO: 29544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggtatgcgtgctactgtactctttccac

SEQ ID NO: 29545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggtccacgtatcgttggtcgttcccggt

SEQ ID NO: 29546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggtcgactgggcattcgcggttcagccg

SEQ ID NO: 29547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggtgactacactgtcttgacggtgggtg

SEQ ID NO: 29548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggtgggaaattgcactgcgtgtggcggt

SEQ ID NO: 29549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcggtttcctcggattgcagcggcccggtc

SEQ ID NO: 29550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtaaccctagaacctattacttttggag

SEQ ID NO: 29551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtaagttgcccgtccaccgtgcgtcagg

SEQ ID NO: 29552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtacgaaccgaagtgggagcgagatagg

SEQ ID NO: 29553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtacttctctttcgattagcgctcaatt

SEQ ID NO: 29554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtcaatcgtacggtaatacgccagctgt

SEQ ID NO: 29555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtcactgttacgattggtgctggctcga

SEQ ID NO: 29556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtcatatttccattagggttcaaaccac

SEQ ID NO: 29557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtcatttgatcacgataccttcgcggcc

SEQ ID NO: 29558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtccactcgtccttcttgcgtcctgtct

SEQ ID NO: 29559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtcccgaaatggtagacagtctaagccc

SEQ ID NO: 29560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtcgatcggctcaggactgtaccgaatg

SEQ ID NO: 29561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtctcgtcgggggagttgaccgtacctg

SEQ ID NO: 29562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtctctactgagtcccttgttcgttcac

SEQ ID NO: 29563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtctgggggaggtacaatgtctgattgc

SEQ ID NO: 29564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtgcaaaagctggggcatccgagcgagt

SEQ ID NO: 29565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtgcaagaaatactcgtacagtagcacg

SEQ ID NO: 29566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtgcttgagtcttgatagcggctaagga

SEQ ID NO: 29567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtggagatgctatggacgtggtggtttt

SEQ ID NO: 29568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtggaggatatcgcgctgtgggatcatg

SEQ ID NO: 29569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtggagggatttaggttttcacagcgtg

SEQ ID NO: 29570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtggcccggaatgtgcggtgaagggggc

SEQ ID NO: 29571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtggcgaatagcccactgggcaaccgct

SEQ ID NO: 29572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtgggacgtttcggcttgagctcggtcc

SEQ ID NO: 29573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtgggtgtgcggaatgtgtggttcacgg

SEQ ID NO: 29574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtgtgctcggatgtgtaacttaccgctt

SEQ ID NO: 29575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtgttaaggtccgctcatgatgcacgat

SEQ ID NO: 29576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgtgtttctagtgctacgaggttcatccg

SEQ ID NO: 29577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgttacatccggttttcacgtgggcccgt

SEQ ID NO: 29578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgttagctcacgtatttgggtggctgggc

SEQ ID NO: 29579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgttctcgtattcgctatcttgctttcta

SEQ ID NO: 29580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcgttgttaaagttccttataaccttgtcc

SEQ ID NO: 29581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctaaagcatcaggattacttcagcgggtc

SEQ ID NO: 29582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctaaggaggacagctaatggtcccgggag

SEQ ID NO: 29583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctaagtgtggggcatgtgatgcaggatta

SEQ ID NO: 29584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctaagttcgcgggggattctcacatattt

SEQ ID NO: 29585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctacaatgtacgtgtgttaagaactgggg

SEQ ID NO: 29586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctacacgtcacgtcgacatggcggcccac

SEQ ID NO: 29587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctacggcacggttgtaacttgtgctacca

SEQ ID NO: 29588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctacggcatctgggggaatgcggttacta

SEQ ID NO: 29589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctacggtcagtctaacagcagtggtcggc

SEQ ID NO: 29590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctactaccggcatccgatttggcacagtg

SEQ ID NO: 29591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctactcagtgtgctcgatgtttctaatgc

SEQ ID NO: 29592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctagacaaagaaacatgtccctgggctcg

SEQ ID NO: 29593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctagctcaagaacccacttcattaactaa

SEQ ID NO: 29594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctagctccacgctgcaatgaggcgcacct

SEQ ID NO: 29595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctaggcgcagttaacggttcccgatctgc

SEQ ID NO: 29596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctagtatcgcatcgttttgtccacgccta

SEQ ID NO: 29597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctataactgagacggtagtgtcctggccg

SEQ ID NO: 29598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctatacctacgtccttctgtgtattggcg

SEQ ID NO: 29599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctatatgcaccgtgcgggttcttctcggg

SEQ ID NO: 29600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctatatggacccggcagctctactaacac

SEQ ID NO: 29601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctatcagagacccaccccgccccgctcgc

SEQ ID NO: 29602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctatgcttggatggtagggtgagaacgat

SEQ ID NO: 29603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctatggactgctgacaggggggtatctgt

SEQ ID NO: 29604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctatgggtcgacctgtttccgttgccacg

SEQ ID NO: 29605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctatggtcttactgtaccgtcgcgaattc

SEQ ID NO: 29606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctatgtcttacggtcccaaagctacgcat

SEQ ID NO: 29607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctattatgagctaaagcttttcacaacgg

SEQ ID NO: 29608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctattgcacggatccactgtctgttcacg

SEQ ID NO: 29609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctattgctctgatcgtgcgttaggctgat

SEQ ID NO: 29610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctatttgcgcaatgcaccaccgactggat

SEQ ID NO: 29611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcaaattagcacactgcgctgagcgttg

SEQ ID NO: 29612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcaacggtgctcctctaagggcccattg

SEQ ID NO: 29613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcacaaacgcctgcgggatgccacgtcg

SEQ ID NO: 29614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcacaacgttttggtttacgctcgtacc

SEQ ID NO: 29615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcacactcttacagtggcagtggccaag

SEQ ID NO: 29616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcacagtttcgccaaatggcgaacacac

SEQ ID NO: 29617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcacgggcgcgtgttttatggccacggc

SEQ ID NO: 29618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcactacttgagtgtacagcttaggtga

SEQ ID NO: 29619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcacttggcgacttcacaatcgttggtc

SEQ ID NO: 29620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcaggtaatcatttaactcccctgtaat

SEQ ID NO: 29621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcaggtcactctgccttgggggagtgtt

SEQ ID NO: 29622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcatagaatctgccggttggcctggaca

SEQ ID NO: 29623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcatcggtttttaggtattgggtcttgt

SEQ ID NO: 29624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcatgaatctccactcccagcccgcagc

SEQ ID NO: 29625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcatgatgatctcctgtttctgtgtgta

SEQ ID NO: 29626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcatgggctcgaatctttaatagttatt

SEQ ID NO: 29627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctccaagctggagtattgcggggtcccgt

SEQ ID NO: 29628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctccatcgtctctgtgcttcttagttagt

SEQ ID NO: 29629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctccatgactcgtttgatcgttaggtacg

SEQ ID NO: 29630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcccgttatagcgaagtgactcctcgtc

SEQ ID NO: 29631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctccgataaagttgcggacggttcggttg

SEQ ID NO: 29632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcctcgggaatacacggctgctgatgct

SEQ ID NO: 29633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcctgtgttttgttcaaatttggccggg

SEQ ID NO: 29634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcgacaaacaggtggttgcgtgtttatg

SEQ ID NO: 29635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcgacggtactggtgcatgttgactctt

SEQ ID NO: 29636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcgattattttctccgccacgtcttggg

SEQ ID NO: 29637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcggcaatgttggggacgaagatgtgtg

SEQ ID NO: 29638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcggtgcctacgcgcattgtgatggttc

SEQ ID NO: 29639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctctacaagtccaagagcgggcatgtgcg

SEQ ID NO: 29640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctctcctctacttcctctgcgtttgccgc

SEQ ID NO: 29641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctctcgagggtgctttggggtctgggctt

SEQ ID NO: 29642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctctgtaccaagacgttccgggaggggta

SEQ ID NO: 29643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctcttgctggccggaagcataactcaata

SEQ ID NO: 29644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgaagttgcaagtctgttaggcacgtcg

SEQ ID NO: 29645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgaccagtgaaggtgacatgtcacgttc

SEQ ID NO: 29646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgacgacagtggaacgagttttagcgca

SEQ ID NO: 29647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgacgatgtgcgaagcgtgggtccgacc

SEQ ID NO: 29648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgacgggtgtgaacatatgcgatatgta

SEQ ID NO: 29649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgatagcagtgatacccgcgagtcctgc

SEQ ID NO: 29650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgatagtgggatacgcgatgacggtata

SEQ ID NO: 29651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgatcaacttttcctataactttgtttg

SEQ ID NO: 29652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgatcctctctgtgtctggggccgcagg

SEQ ID NO: 29653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgcaaacaagatcgctgccatgacgaca

SEQ ID NO: 29654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgcaactcgagactaataccccccggtt

SEQ ID NO: 29655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgcaatcacaacttagggaccacgggcc

SEQ ID NO: 29656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgcagtcgagggcatcttggtagtgtgc

SEQ ID NO: 29657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgcctggcgttgtaatccggttagcgac

SEQ ID NO: 29658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgcgtgaggtctctacagcgtcttcccg

SEQ ID NO: 29659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctggagaaactggccacggggggtacggg

SEQ ID NO: 29660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctggaggtgcgttgtgcctgagagttggg

SEQ ID NO: 29661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctggatccgtgcgtaggctactttatggg

SEQ ID NO: 29662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctggcaggtgttcaaatacgccaatgttc

SEQ ID NO: 29663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctggcccatgtggtgctaagtacttagca

SEQ ID NO: 29664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctggcgaggtggtaccatcacatgttttc

SEQ ID NO: 29665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgggaatcgcgttaaattagttgcgtgg

SEQ ID NO: 29666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgggattcagttgtttacagtacacaga

SEQ ID NO: 29667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctggggacgcgaactggtgtcgcatacgt

SEQ ID NO: 29668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgggtcttctagaaatacgtatacggcg

SEQ ID NO: 29669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctggtagcgacgcggaatttggggtgtca

SEQ ID NO: 29670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctggtctcatgggacattaagtgccgggc

SEQ ID NO: 29671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctggtgtcgcaggtgacttagattgggca

SEQ ID NO: 29672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctggttgcagtgcttttcccattcactct

SEQ ID NO: 29673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgtaaatgaactgtttgtctcgtttctt

SEQ ID NO: 29674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgtcaattgtgatctgtatcaagactgc

SEQ ID NO: 29675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgtcattgcatacggaattatgtcggat

SEQ ID NO: 29676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgtgaataagcgacaacgatcccttatg

SEQ ID NO: 29677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgtgaggctcgggattgtcgtttccgac

SEQ ID NO: 29678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctgtgtattcggaggggaagacatcgggc

SEQ ID NO: 29679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttaacggaaaccttgggagcatctgaga

SEQ ID NO: 29680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttaccgatgccaaattgcacgggaataa

SEQ ID NO: 29681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttattcctattggtggtccggttaacac

SEQ ID NO: 29682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttattcgagcacggtggggctctgttcg

SEQ ID NO: 29683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttcaaatatgccgcaggattccatcggc

SEQ ID NO: 29684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttcaatgcatctatggctcttctgggtg

SEQ ID NO: 29685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttcacacagacacttgagcggatcagcg

SEQ ID NO: 29686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttccatttacatggactagtgtgtgaga

SEQ ID NO: 29687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttccgagatgtgcgactgacgttactta

SEQ ID NO: 29688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttcggcgctattcttcgtcaactctagg

SEQ ID NO: 29689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttcgggcagcagctattccagtcagcgg

SEQ ID NO: 29690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttcgtagctccgtttggtagtagaatcg

SEQ ID NO: 29691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttctgagtgtcacgtcatccgtctaatc

SEQ ID NO: 29692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttctttcactgtagtcccctgcacaagc

SEQ ID NO: 29693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttgaacctgcctcagcccccacagttgt

SEQ ID NO: 29694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttgacaatgtgtcgctaatagtggcctc

SEQ ID NO: 29695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttgcacctcaccacgagtcggtccattt

SEQ ID NO: 29696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttgctgagtggttcatagttcgcgggca

SEQ ID NO: 29697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttggtttcggcgatgccccaagggaccg

SEQ ID NO: 29698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggcttgtcgcttcacacgggaatcatgggcc

SEQ ID NO: 29699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctttaagactgatactgtcagctgatgtc

SEQ ID NO: 29700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctttagcggccaccattaccctaccccgg

SEQ ID NO: 29701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctttcgtaactccgccataagcatgcttt

SEQ ID NO: 29702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggctttggagcaccgcgttgcttgttatagc

SEQ ID NO: 29703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaaaaccaggaggatcggattctcccctg

SEQ ID NO: 29704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaaacgagaccgtaccaatccggggacgt

SEQ ID NO: 29705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaaagcgcgggttaaatggtacgctcttg

SEQ ID NO: 29706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaaatggacctaaggcgcgtgtggttgca

SEQ ID NO: 29707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaaatgggagtccttgcactggtgacttg

SEQ ID NO: 29708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaacaacgtagaccggttatgccatgtca

SEQ ID NO: 29709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaacacttgtttgtgcaccacagttgtga

SEQ ID NO: 29710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaacagggtcgagcgatctatccgtctgg

SEQ ID NO: 29711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaacgactctcttgtaacggacatgggtg

SEQ ID NO: 29712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaacggaacagcgggtaataatgcctggc

SEQ ID NO: 29713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaacggttttggcagatcgcagagagatg

SEQ ID NO: 29714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaacgtctacgtcgcaatctgcctatcgg

SEQ ID NO: 29715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaacgtgaagtatgctaggcggtggtagt

SEQ ID NO: 29716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaacgttcccggcggtttaagagtgctgc

SEQ ID NO: 29717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaagaacgggcccgcacctagagccgcgt

SEQ ID NO: 29718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaagataggtggtatttcggcgtttcact

SEQ ID NO: 29719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaagccacggaaccgggcggggggtatta

SEQ ID NO: 29720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaagccgaaacacgggtgttagccgtcct

SEQ ID NO: 29721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaagcgatgggtcagttgcatgatgctcg

SEQ ID NO: 29722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaagctagatgtaggttcttgtccctctc

SEQ ID NO: 29723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaaggaattggtggaaggcgaggcgcact

SEQ ID NO: 29724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaaggattggcgccactttgctctatcag

SEQ ID NO: 29725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaaggcaattggccgctttagcgacgatc

SEQ ID NO: 29726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaagggatattggagcggtgccttcgaat

SEQ ID NO: 29727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaagggccccgttggcttagatctgtgcg

SEQ ID NO: 29728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaagggggtgtcgatgattatgtatgccg

SEQ ID NO: 29729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaagtcctaggacggtctgcaaacgcgcg

SEQ ID NO: 29730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaatcgcaaggtatcggcacaagttaggc

SEQ ID NO: 29731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaatgcaaggagttttccctgttataggc

SEQ ID NO: 29732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacaaaggacaccatgaggggcagtggcg

SEQ ID NO: 29733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacagacacagaggtagacggcttccggc

SEQ ID NO: 29734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacaggcaacgtacaagatgtggcgctgt

SEQ ID NO: 29735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacaggtgcggcgtggaaagtttacggtg

SEQ ID NO: 29736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacatcggaccgctgggtgtgatgttgcg

SEQ ID NO: 29737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaccaagtctgtttcttatcgcgaccggg

SEQ ID NO: 29738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaccacgggatgacatttgttccctagcc

SEQ ID NO: 29739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaccagtcaaagcgcacccgactgcgggg

SEQ ID NO: 29740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacccctgtgcatgtagatcgggcttctt

SEQ ID NO: 29741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaccgttcaccatgttgatcatcctcggc

SEQ ID NO: 29742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacctgatggtagcttacaatggttccct

SEQ ID NO: 29743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacgaaagatcactgctatgtagggggta

SEQ ID NO: 29744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacgacttacattttgcgcacctgttatc

SEQ ID NO: 29745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacgacttccaaggttctgcttatttttt

SEQ ID NO: 29746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacgagagctggaattgtaaatcgggctg

SEQ ID NO: 29747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacgagtgagaggcgttgtggtgaaatgg

SEQ ID NO: 29748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacgatacagtcaattgacatggtcaagg

SEQ ID NO: 29749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacgatgtgggcgcgtgggaagcttcgaa

SEQ ID NO: 29750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacgattcgtagaccaggacctgtcgggg

SEQ ID NO: 29751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacgcaagctttacgcgcttcgagtgtgg

SEQ ID NO: 29752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacgcgccagcacccatacgatttatcta

SEQ ID NO: 29753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacgcgggtcacatttctccatttcggag

SEQ ID NO: 29754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacgcggtgacacaggtgcagatgtggcg

SEQ ID NO: 29755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacgctgagttggcggtgatcgtttccgc

SEQ ID NO: 29756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacgctggatggtggttaccattttaggt

SEQ ID NO: 29757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacggccagcagaagggcccgggggccat

SEQ ID NO: 29758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacggctctgttctgctaacgccgcgggt

SEQ ID NO: 29759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacggttccctctagagcagcttcggacg

SEQ ID NO: 29760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacggtttcaagcgtctcggggaggagga

SEQ ID NO: 29761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacgtacagtgtcataaggcaaatgcgtt

SEQ ID NO: 29762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacgttaggctgctacacttcgagttacg

SEQ ID NO: 29763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacgtttatgagcgacattaggatcctga

SEQ ID NO: 29764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggactaggctgtgatcctagtgtcgatact

SEQ ID NO: 29765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggactcagggatggtagtccgtgtcttgct

SEQ ID NO: 29766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggactcccaaatgctaaccattcctctgtg

SEQ ID NO: 29767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggactcttgtttttcgttactaaggtcaga

SEQ ID NO: 29768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggactggggccgaagcgacacccgaacatg

SEQ ID NO: 29769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacttacccatcaagacctttaggcaatg

SEQ ID NO: 29770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacttagaacgacgtcctctctcgcgcaa

SEQ ID NO: 29771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggacttagagatggtgttttgtgattgtac

SEQ ID NO: 29772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagacacacccaaaatacggatgaggtga

SEQ ID NO: 29773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagacagaagtagaggtgcaccgagggag

SEQ ID NO: 29774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagaccgacggggattggtacataagcgt

SEQ ID NO: 29775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagagggtgtgcgacaaattttctaccac

SEQ ID NO: 29776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagagtctttgtagcacagcagcggattg

SEQ ID NO: 29777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagatgttacgggggggcggacggtctag

SEQ ID NO: 29778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagcacgggtcctctaatgctctggtttc

SEQ ID NO: 29779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagcagaaagaagtgctttcttgtcccca

SEQ ID NO: 29780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagccaaactcagcatagcccgaggtcgt

SEQ ID NO: 29781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagccagcgcaagcctacgctactcgatg

SEQ ID NO: 29782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagcccgtccgtatgtgccgctcctccgt

SEQ ID NO: 29783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagcgagaaggacgaccagggtataccgc

SEQ ID NO: 29784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagcgtggccactacctccggggttccgt

SEQ ID NO: 29785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagcgttttagaaatcagcgagccaggct

SEQ ID NO: 29786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagctcggtttggatgcgcgggtgtcggc

SEQ ID NO: 29787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagcttagtagtcttgcgtgccgttatcg

SEQ ID NO: 29788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaggaagacctcaggctgctgctggcgga

SEQ ID NO: 29789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaggaatcgaggcccctgtcagtttctga

SEQ ID NO: 29790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaggaccgagtgaggcgcattctcacgcc

SEQ ID NO: 29791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaggacgggaccgcagtatgctgctaatc

SEQ ID NO: 29792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaggagggaaacgctatgtgtagtggtgg

SEQ ID NO: 29793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaggagtccggggtaagggagatgaaagg

SEQ ID NO: 29794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaggatagtcattggccagttgcaaccgc

SEQ ID NO: 29795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaggatctttctgtagggacaacgccatg

SEQ ID NO: 29796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaggccacgatacgtagactaatgttgtg

SEQ ID NO: 29797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaggcgcacgttcaggccgcaaagctgct

SEQ ID NO: 29798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagggaaagattgctgtaaacgcgagtat

SEQ ID NO: 29799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagggcaggtagtgatgatttcacacgat

SEQ ID NO: 29800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaggggggccatcagatgtgttcagggct

SEQ ID NO: 29801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagggtccttcatgctcaacatctgctgc

SEQ ID NO: 29802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaggtccaacactcactcgctgtactccg

SEQ ID NO: 29803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaggtgagggtccctgtctgtcgagctag

SEQ ID NO: 29804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaggttcttcgtccggcaacctgcgtgca

SEQ ID NO: 29805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggaggtttatggtgggatccgcgaccactt

SEQ ID NO: 29806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagtaacggatctgtcgccctattaccat

SEQ ID NO: 29807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagtcacgccctcacgttacgctacttca

SEQ ID NO: 29808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagtgcgtagtagcggccagatgcagttg

SEQ ID NO: 29809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagtgtaagttgggagccgtagttaatcg

SEQ ID NO: 29810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggagtttaccggaaggttacgttggggggc

SEQ ID NO: 29811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatactaggtccggtgtcgtgctctctgc

SEQ ID NO: 29812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatagcccagttcctgtcgaacgctggcc

SEQ ID NO: 29813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatagggggtgctcacgtcattcttggcg

SEQ ID NO: 29814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatattctcttctcgcgtcatgagttccc

SEQ ID NO: 29815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatcagccactctcggtactaatcatcgg

SEQ ID NO: 29816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatccaccctggccggcgatctaagtggg

SEQ ID NO: 29817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatccaggtacagatgaccgccagcctag

SEQ ID NO: 29818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatccatggcgactctattgtgctaatcc

SEQ ID NO: 29819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatccgaatggatggttccaccaccctgc

SEQ ID NO: 29820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatcgatagcacttactggtaacccggga

SEQ ID NO: 29821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatgactgtaaatgcctaccctctccgga

SEQ ID NO: 29822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatgctcctcgtagcgtcccacctgcgcc

SEQ ID NO: 29823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatggagctcgttcgcacgtgtgaagccg

SEQ ID NO: 29824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatggaggtgcgcgtgactctgaaatagg

SEQ ID NO: 29825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatggctccttcaggaagtcgtggcggtg

SEQ ID NO: 29826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatgggttcggcatacatcgcaactggca

SEQ ID NO: 29827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatggtgctcaataagtcggccgcatgtc

SEQ ID NO: 29828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatggtggtctcagcgttgctttgtcggg

SEQ ID NO: 29829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatgtcatgcaggtgctgaaagcttacgc

SEQ ID NO: 29830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggattaagactcataacgtcagggtcctat

SEQ ID NO: 29831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggattaagtggccttggtttagaatagggc

SEQ ID NO: 29832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggattacgctttgttccgatcatggctcgc

SEQ ID NO: 29833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggattcacatacctgtacgaagagcccagt

SEQ ID NO: 29834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggattcactggttgtttgtgtaggtaccct

SEQ ID NO: 29835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggattcagactgacacttggagtggaggta

SEQ ID NO: 29836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggattcggtctgctatagtagtgttctagc

SEQ ID NO: 29837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggattgatcacggcatcgtgtgggttgacg

SEQ ID NO: 29838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatttatgcgacgcgtcagaaccactgtt

SEQ ID NO: 29839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggatttcacactttaactgataccgcaagc

SEQ ID NO: 29840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcaaaaggtcgcttggtacggcaatgttc

SEQ ID NO: 29841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcaaactgtcttagaggcggcggttgttt

SEQ ID NO: 29842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcaaagcacaggtaaaagagtaactttga

SEQ ID NO: 29843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcaacatctcttagtaagcacatgtttgt

SEQ ID NO: 29844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcaactctcgaattccccttgccgtttgg

SEQ ID NO: 29845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcaagcagaatcgattgcaatttccgggg

SEQ ID NO: 29846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcaaggatgctgtcctgtatcttaagacg

SEQ ID NO: 29847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcaagtgaggggctcagaatgtagggcat

SEQ ID NO: 29848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcaatagcacgcgactgctgtgttgcgca

SEQ ID NO: 29849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcaattcttctgctatgctcgataatcac

SEQ ID NO: 29850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcaatttaacaagcctcacatcttcgaaa

SEQ ID NO: 29851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcacaagcaaattaggtttcatctgattc

SEQ ID NO: 29852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcacacgcagtcgtatgctcggcattggg

SEQ ID NO: 29853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcacagcgtgtagtccgggtcccttgtgg

SEQ ID NO: 29854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcacaggaatgcacatcgtagtggtgtgg

SEQ ID NO: 29855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcacaggtaagcatcgccagctgacaggc

SEQ ID NO: 29856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcacatccttgaccttggttatcatcgca

SEQ ID NO: 29857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcacgacaattgaggagataggatggaga

SEQ ID NO: 29858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcacgccttaatctcgacatggttaacga

SEQ ID NO: 29859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcacgctggcgggatcgaggtggtcctac

SEQ ID NO: 29860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcacggagtctagtcggtttcgacgggtt

SEQ ID NO: 29861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcagaataggctccattaacctgctgtag

SEQ ID NO: 29862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcagatcgtcttcccacaacctccacgcc

SEQ ID NO: 29863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcagcaaaggggcggagccaggacagact

SEQ ID NO: 29864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcagcgagtggtgggggaccaacctgtgg

SEQ ID NO: 29865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcagcggaaaggaggaatcctctgaagtg

SEQ ID NO: 29866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcagcggtcaggtgatgatgggaggctcc

SEQ ID NO: 29867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcagggatcaggtatagacaccctaccgt

SEQ ID NO: 29868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcagggatgtaggagcggtcttgcgggct

SEQ ID NO: 29869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcagggccgagtggtacaggatcatcatg

SEQ ID NO: 29870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcagggtatcgcgggttgcgtactgattg

SEQ ID NO: 29871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcaggtgggggatcactgcaaggcacggg

SEQ ID NO: 29872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcagtttgggatgcctgctgtggaccagt

SEQ ID NO: 29873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcataaagggcatcagggagttcttttcc

SEQ ID NO: 29874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcataactcctcctcggacatttgccgtg

SEQ ID NO: 29875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcataagtgtgcggtcataggtctaggac

SEQ ID NO: 29876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcataggtggacatccgttgaccgtgtat

SEQ ID NO: 29877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcatatgggtagatcggtcttcattggac

SEQ ID NO: 29878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcatccgcacggtcggcgaacttaagttg

SEQ ID NO: 29879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcatccggttcagagacccccgatatgca

SEQ ID NO: 29880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcatccgtgcgttcttgttcagacaatgg

SEQ ID NO: 29881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcatcgaggggtttgatagcggcagtgtc

SEQ ID NO: 29882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcatcgcaatcgcttcctcaggcaactag

SEQ ID NO: 29883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcatcggattcaaatgttcatatgcgcgt

SEQ ID NO: 29884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcatctgaccggcttctaagactctctac

SEQ ID NO: 29885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcatgcgtttgcattttcggcgctattta

SEQ ID NO: 29886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcatggattagcattctttgggtgggatc

SEQ ID NO: 29887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcatgttgctccgagcgtacgcgggcttc

SEQ ID NO: 29888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcattcatccactgttctccccagccggg

SEQ ID NO: 29889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcattgttctaagcgtatgtgccgctgct

SEQ ID NO: 29890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcatttgagctaagggatttcgtggttat

SEQ ID NO: 29891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccaacccccagagcaaacgcaatcgtac

SEQ ID NO: 29892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccaacgtgcagaccaaattattatccaa

SEQ ID NO: 29893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccaccgtacctaggatgtggggattaaa

SEQ ID NO: 29894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccaccgtagcggtgtgaacgggcaggga

SEQ ID NO: 29895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccaccttcttggaaattgtcatgcgggt

SEQ ID NO: 29896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccaggacgacgtaccgtctcgtacacgg

SEQ ID NO: 29897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccagtccaacggttttgctcatgtaatg

SEQ ID NO: 29898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccattaacgctattgtgctaacttcagg

SEQ ID NO: 29899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcccacttaggaaacttcacaagattttt

SEQ ID NO: 29900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcccaggaccatctgctccgtggttaacc

SEQ ID NO: 29901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcccagtttcgatgtatcacttcgtccct

SEQ ID NO: 29902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccccctcatgagtattaaccgtgtctgc

SEQ ID NO: 29903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcccgactgacagtgcgaagcttcaccga

SEQ ID NO: 29904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcccgctggctgcttggaccgattccgag

SEQ ID NO: 29905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcccggcgctcacggtccacgttcttgtt

SEQ ID NO: 29906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccctctgtagtggagtagaggcgcttcc

SEQ ID NO: 29907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccctgatgggaggcatgtcgtccggaga

SEQ ID NO: 29908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccgagcggtcgcagatacccatagtctc

SEQ ID NO: 29909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccgcaggaagttcgtaacattcgcgatg

SEQ ID NO: 29910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccgctcatctgacattctcttgtacccc

SEQ ID NO: 29911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccgctgctgcttaaaggtaatcgggcgt

SEQ ID NO: 29912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccggaacttatccctacagctatatacg

SEQ ID NO: 29913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccggatgcatcgaccacagcctcgcata

SEQ ID NO: 29914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccgtaacgcataactagcgacacccaag

SEQ ID NO: 29915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccgtaatgagcttgaccacgggggaaaa

SEQ ID NO: 29916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccgtaggactcctatgagctgcgcctgt

SEQ ID NO: 29917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccgtcaattcccgggcacagcagctggg

SEQ ID NO: 29918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccgtgcggatccattcggacgggtaaag

SEQ ID NO: 29919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccgtgttccggtacgggccagaactggg

SEQ ID NO: 29920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccgttacttgggtgccaggtctcagagt

SEQ ID NO: 29921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcctagcgcctgcgtaaggaagctcgcgt

SEQ ID NO: 29922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcctcacggtcttccaagtttgtccgggg

SEQ ID NO: 29923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcctcccaccggggagacagtagacgttc

SEQ ID NO: 29924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcctcgcgtcgtcccaacttggctctgtg

SEQ ID NO: 29925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcctgcaatttacatcgcttagaccggat

SEQ ID NO: 29926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcctggtgcagtgcgggagtaatgcggct

SEQ ID NO: 29927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcctgttctcatctgcgtggtggctgcat

SEQ ID NO: 29928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccttaaggtaaaccccttggcgaggaga

SEQ ID NO: 29929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggccttgtgaagctgggaatgtgggtcagt

SEQ ID NO: 29930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgaaggcaacacggattggttccctggg

SEQ ID NO: 29931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgaaggctggccgctcgcggacttcgta

SEQ ID NO: 29932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgaagtctgtggggctcgtttcagtgtg

SEQ ID NO: 29933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgacagttttgtggttgtgaggaccgtg

SEQ ID NO: 29934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgacctatcaagtgtagcggtcactttt

SEQ ID NO: 29935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgacggatagaacaaacacgtcagctcg

SEQ ID NO: 29936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgactgatctacacggtgaggcggacgc

SEQ ID NO: 29937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgactggtattgcacggggacggattag

SEQ ID NO: 29938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgactggtggcatgggctgtggcctagc

SEQ ID NO: 29939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgagatacggattcattcagtaccatct

SEQ ID NO: 29940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgaggacatagttcggttaggttgagat

SEQ ID NO: 29941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgagggataaagacgattcgggctatgg

SEQ ID NO: 29942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgagggatggatcctaggagggctcgtt

SEQ ID NO: 29943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgagggttgcgtcgattaggtagggggg

SEQ ID NO: 29944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgatcgggggcgtgggtagtgacacatc

SEQ ID NO: 29945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgatcttccgtagcaactgcgctcgaac

SEQ ID NO: 29946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgcactcaggcattttacactaaaggtg

SEQ ID NO: 29947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgcatccaccaatgatcggccacacgtt

SEQ ID NO: 29948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgcgagcacactggaacggctcaacgcc

SEQ ID NO: 29949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgcgcagatgaccagctgtttcacctgg

SEQ ID NO: 29950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgcgcgacgtgtataacgcgttatcctg

SEQ ID NO: 29951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgcggtatagaggtgagacacgtcggtg

SEQ ID NO: 29952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgcgtcactggtttatctaggggccaga

SEQ ID NO: 29953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgcgtccaagtcgtaaacggttaagggg

SEQ ID NO: 29954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgctagggcggaggtatttctggaggaa

SEQ ID NO: 29955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgctatccgggatgggccactcgtgctt

SEQ ID NO: 29956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgcttgctagtggtggtgttagtgtgga

SEQ ID NO: 29957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcggaagtgcgttcaaggttcggtagacg

SEQ ID NO: 29958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcggatcgggggtgagccagtttttctgt

SEQ ID NO: 29959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcggcatgggctgatctgttccggacgga

SEQ ID NO: 29960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcggccagttagagaccaacgtgattagc

SEQ ID NO: 29961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcggccgaactgacctaggactcgacggg

SEQ ID NO: 29962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcggccggctaaagttgcgggtgcaggat

SEQ ID NO: 29963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcggcctccctggtgtaaaataactctgt

SEQ ID NO: 29964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcggcgacatatcagtgttcccggtatga

SEQ ID NO: 29965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcggcgtaagcataaattcggtgtatacg

SEQ ID NO: 29966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgggactgaacatctgacgcgggactcc

SEQ ID NO: 29967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgggagagccattttggtcgggtgctta

SEQ ID NO: 29968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgggatagagtagtggacgatatatcga

SEQ ID NO: 29969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgggattggtcgttgctcgtccacgact

SEQ ID NO: 29970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgggcgttctcgaaattctacaccggca

SEQ ID NO: 29971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcggggtccagagtcgtcgggtgactgct

SEQ ID NO: 29972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcggtcgggcttacttcctaaacactggc

SEQ ID NO: 29973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcggtgctggtgaacctgcttggtaaggc

SEQ ID NO: 29974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcggtggcaggcgagatgctagattaggg

SEQ ID NO: 29975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcggtggtgaggtacggttctttaagggc

SEQ ID NO: 29976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcggtgtgcttgactcctgacccttgatt

SEQ ID NO: 29977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcggttcgtcttctgagatatatgggccg

SEQ ID NO: 29978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgtacatcccaggcgaaggtagggtcac

SEQ ID NO: 29979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgtacgttaagacgatacctcggcgacg

SEQ ID NO: 29980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgtcattgcgggcgagcttgttcacgcc

SEQ ID NO: 29981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgtccgaacgtccatgcagtgtgtgtgg

SEQ ID NO: 29982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgtccgagctgcgggtacggtttggact

SEQ ID NO: 29983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgtgacgagcctaccgtgttgttgcgga

SEQ ID NO: 29984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgtgcagagagcgcgttattcgcgggac

SEQ ID NO: 29985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgtgcttatcccgttcggtcgcttgctc

SEQ ID NO: 29986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgtggaaagcccttttggatcgtttacc

SEQ ID NO: 29987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgtgggttaaagcgcgtaagcagtcggg

SEQ ID NO: 29988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgtgttgaccgattgtcgtatgtgatat

SEQ ID NO: 29989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgttattcgctgattttgtctgtgaagt

SEQ ID NO: 29990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcgttttatggaagcgctcatcttctggg

SEQ ID NO: 29991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctaaagacttccctcacattgcttctat

SEQ ID NO: 29992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctaacatgttcctcgggcgtaggtaaac

SEQ ID NO: 29993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctaactgttgacgagatgtgttttaggg

SEQ ID NO: 29994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctaatgctttggcgttctagaggaaacg

SEQ ID NO: 29995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctacatgcttaccctgtagactctatgg

SEQ ID NO: 29996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctagcaatcgaagatgtgagtgggccat

SEQ ID NO: 29997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctaggtggggtgggtcgcgagtgttcat

SEQ ID NO: 29998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctatcacacatcggccagcgttagttag

SEQ ID NO: 29999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctatgacatcgaccagttaaactgtcaa

SEQ ID NO: 30000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctatgcacggtggccagttggtatggcg

SEQ ID NO: 30001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctatgctcggaggaggcttctgggcggg

SEQ ID NO: 30002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctcgaaggtatatgcaaagtcggtagcg

SEQ ID NO: 30003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctcggtcctggacaggtggcggtcgctc

SEQ ID NO: 30004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctgaagggacggaactagtggctctggt

SEQ ID NO: 30005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctgaagtccgtcttgtcttatgagcatc

SEQ ID NO: 30006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctggacacgcgcgtcgttcattttaagg

SEQ ID NO: 30007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctggtcggcatgctatcttatatcgact

SEQ ID NO: 30008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctgtgtgtgcgttacgtgggcggtcccc

SEQ ID NO: 30009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcttagcgttggttacgtgccagttcgtc

SEQ ID NO: 30010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcttatgcggaagtccttggcggataccg

SEQ ID NO: 30011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcttgccgtcgttagaataagttgcgacg

SEQ ID NO: 30012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcttggggtgtggtcagcccgactctcac

SEQ ID NO: 30013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggcttgtgtctccgatttgtggccttgggt

SEQ ID NO: 30014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctttagacgagccgaacagggcgaatcc

SEQ ID NO: 30015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggctttgtacggattagtttcggtcctatt

SEQ ID NO: 30016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggaaatcgatggtttaggagcatttgatg

SEQ ID NO: 30017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggaaatgtgtcccggagacggggttccct

SEQ ID NO: 30018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggaaattctgtgcactgatcgagcgcacg

SEQ ID NO: 30019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggaacgctgagccagactcaaggccgggg

SEQ ID NO: 30020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggaagcatgctcgttttgaacgcgttatc

SEQ ID NO: 30021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggaagctatgttttatacagattcggtcg

SEQ ID NO: 30022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggacaagctgctaccctgctctaagtcct

SEQ ID NO: 30023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggacagaggcggcccttgggactaggtcg

SEQ ID NO: 30024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggacagctcttattgctgcgttactgagt

SEQ ID NO: 30025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggacaggggcagcgtcacacaggatgttg

SEQ ID NO: 30026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggacaggtcttggcctgctgcgcagattg

SEQ ID NO: 30027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggacatgctcggtgggggtacgcgcgacg

SEQ ID NO: 30028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggaccaaaaggcatcgtatcatattctca

SEQ ID NO: 30029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggaccgcaagcgcgacatcccagggtcgg

SEQ ID NO: 30030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggacctatgcgattgaagcctacccgggg

SEQ ID NO: 30031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggacgagcacagagccctagaagactcgg

SEQ ID NO: 30032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggacgatcaccggagcttcgccagattcg

SEQ ID NO: 30033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggacgcacctcgcagtatcttggcggtct

SEQ ID NO: 30034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggacgggagtaactggcgtattggcaacg

SEQ ID NO: 30035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggacggtgtacgacaggtcagtggggtcg

SEQ ID NO: 30036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggacggttcctccgggactaaggcggatg

SEQ ID NO: 30037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggacgtatcggtgcggggttgaggctcgt

SEQ ID NO: 30038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggacgtctgatctcgtggtgtagcttgta

SEQ ID NO: 30039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggacttggcattaagaatttcaaccatac

SEQ ID NO: 30040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggagacgtcccgaagctggggcgttatga

SEQ ID NO: 30041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggagataacagggactcgaccggaagtgt

SEQ ID NO: 30042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggagatatcgtcacaattcacgacagatt

SEQ ID NO: 30043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggagatggtgatgacctgggcacaacaac

SEQ ID NO: 30044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggagatttggtctgttctgtgaagcttgg

SEQ ID NO: 30045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggagcccccagaaaggccacccttgtagc

SEQ ID NO: 30046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggaggactcgtatttgctcctcctcatat

SEQ ID NO: 30047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggaggactgggctcgttgccgatcctccg

SEQ ID NO: 30048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggagtatccgaagagataggcaacgtcac

SEQ ID NO: 30049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggagtcaaccaccggggtggcgcgagtga

SEQ ID NO: 30050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggagtgggccttcgctaggtgtgcagacg

SEQ ID NO: 30051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggagttacaccatgagaagcgccatgttt

SEQ ID NO: 30052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggatagctgtcacagtggcaagcacggta

SEQ ID NO: 30053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggatcagcgcggccctgaacactgcttgg

SEQ ID NO: 30054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggatcgggcgtggacatctgagccgcttt

SEQ ID NO: 30055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggatctgtgccgggttgtgcagttttacg

SEQ ID NO: 30056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggatgagtacctcccgctcttaggccctc

SEQ ID NO: 30057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggatgcattccgcgtcgagtttaggcatg

SEQ ID NO: 30058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggatgctgtggtcctattcaaggcggcaa

SEQ ID NO: 30059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggatgtacctggattggccctaccggacg

SEQ ID NO: 30060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggatgtttatgcaggttactatgagtgct

SEQ ID NO: 30061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggattaaaacatgcctcgaacagcgtgca

SEQ ID NO: 30062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggattaggagggaaagccaggcttggacc

SEQ ID NO: 30063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggattggagactaagctgggacatgagtc

SEQ ID NO: 30064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggattggcttagaacttacgttagcaatg

SEQ ID NO: 30065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcaaacgctcagctccttctcaccctcc

SEQ ID NO: 30066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcaacgtttagtggtttacagtgtggtc

SEQ ID NO: 30067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcaagtaagcaatcggttaatgtgctgt

SEQ ID NO: 30068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcacatagtggggatcgggtttcgtagg

SEQ ID NO: 30069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcacatgcttgtagtacattccagcacc

SEQ ID NO: 30070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcaccttcgttttacttgattgaactag

SEQ ID NO: 30071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcagcattggtccctcggacagcactta

SEQ ID NO: 30072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcagctaacagcgaatgcctcgacacgc

SEQ ID NO: 30073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcaggcacgagggttactttgggtggtt

SEQ ID NO: 30074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcaggctagagatttccgggcagcggtg

SEQ ID NO: 30075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcagggcccacggaattatcaatctctt

SEQ ID NO: 30076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcaggggccggaattcaggtggtggtct

SEQ ID NO: 30077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcagttcccggagaagggggcttttgtt

SEQ ID NO: 30078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcataacaggcacacattacggctggac

SEQ ID NO: 30079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcatagcagaatagagggtctcagcacg

SEQ ID NO: 30080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcatattgggctgtccaccgtagactgg

SEQ ID NO: 30081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggccaagtcaaagcaggcgaaaagagacg

SEQ ID NO: 30082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggccatgtttgcatatctccaggccgact

SEQ ID NO: 30083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggccattggagtctgttcccggtgggctt

SEQ ID NO: 30084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggccgcgtgacttaaggctgtgggcaggc

SEQ ID NO: 30085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggccgtttcggtaaagtgttattgtggca

SEQ ID NO: 30086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcctggagtgtacctcgacctagatttt

SEQ ID NO: 30087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcgaagctgtttgacgtagcacgccggc

SEQ ID NO: 30088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcgacggtgcaataaggggttcactgct

SEQ ID NO: 30089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcgagtagtgcgcaagggaggcgcgata

SEQ ID NO: 30090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcgataatcttatgcgtaagtgacgtac

SEQ ID NO: 30091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcgattcgaatagggcacactttgcagc

SEQ ID NO: 30092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcgccacgattgttctgtccgcgcggct

SEQ ID NO: 30093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcgcgaggagggtcaattggtgacggcc

SEQ ID NO: 30094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcgcgatgtgaacgtcaaagatgttggg

SEQ ID NO: 30095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcgcgcctgacgggttaactggtaagga

SEQ ID NO: 30096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcgctgggtttgctgggagaagggggcg

SEQ ID NO: 30097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcggaagcggatcgtgtgattcactatg

SEQ ID NO: 30098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcggatggccgaccccggtgaatatcta

SEQ ID NO: 30099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcggccatctcctcaggtggcgacgggc

SEQ ID NO: 30100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcggccggtaataggattggacttgtac

SEQ ID NO: 30101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggctcagcggtgaaggttgaccagttgtg

SEQ ID NO: 30102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggctgagcttcatgatagccagcgaaacc

SEQ ID NO: 30103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggctgctgggcctcggggggatcttgtta

SEQ ID NO: 30104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggctggagagcggggtttctgcttgacct

SEQ ID NO: 30105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggctgggcttcagtgtggcagccggaagt

SEQ ID NO: 30106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggctgtaaggtgtttaaaacaggacgttc

SEQ ID NO: 30107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggctgttacatgtgcgagaggtacgtggg

SEQ ID NO: 30108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcttcggaatgcattacagatggttttg

SEQ ID NO: 30109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcttggggatttataatgctacttacgc

SEQ ID NO: 30110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggcttgtatggttcggaacttagactcca

SEQ ID NO: 30111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggaaatagcaagatacctgtgagccacg

SEQ ID NO: 30112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggaacagtcaacggccgtagcgtgcacg

SEQ ID NO: 30113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggaacgatcaaggggaagtaaccgaccg

SEQ ID NO: 30114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggaacgtcacctggctgccacactccta

SEQ ID NO: 30115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggaactgggacttggagcttgtggcatg

SEQ ID NO: 30116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggaacttcttcacggtgcgtgccacgga

SEQ ID NO: 30117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggaatgagttaggagggaagatatcgat

SEQ ID NO: 30118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggacatagcaatgggtgttgtccgaggt

SEQ ID NO: 30119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggacctggtacgacatccactctagcgt

SEQ ID NO: 30120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggagaccgcgcgctacctaaagccccgt

SEQ ID NO: 30121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggagaggtttgaggtaatggatcgtgac

SEQ ID NO: 30122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggagctcgccaggccatgggatacacat

SEQ ID NO: 30123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggaggcggtgaagcttgtggtatggcgt

SEQ ID NO: 30124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggaggggatgtgtgacggggaacgttaa

SEQ ID NO: 30125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggaggtatgttgtactggaaagagaggg

SEQ ID NO: 30126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggagtgttgggtggattgctggagtcga

SEQ ID NO: 30127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggattgctacgtagcgaatcggttaggc

SEQ ID NO: 30128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggcacgtattcgagagtcaggtgcgcca

SEQ ID NO: 30129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggcactccggcggtggacagaggtggta

SEQ ID NO: 30130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggcagtgcagagtccttagtgttggcgg

SEQ ID NO: 30131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggcatgtagaagctagcgtcgtcccggt

SEQ ID NO: 30132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggccaagtcattgtgtccgcaactaccg

SEQ ID NO: 30133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggccgtttagtcatttcgtctgcggtta

SEQ ID NO: 30134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggcctacgattgtaagtcactagttttg

SEQ ID NO: 30135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggcgagcctcgactcactgtggtcggat

SEQ ID NO: 30136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggcgagggtctgcgctttgagtgctgcg

SEQ ID NO: 30137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggcgatcatccctcccactggattcact

SEQ ID NO: 30138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggcgatccggggcagttgttcgtcacgg

SEQ ID NO: 30139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggcgcactttcgtctatcacggcggttg

SEQ ID NO: 30140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggcggacgttgaccccgcgaccggtatc

SEQ ID NO: 30141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggcggcaacggacgtacggacatgcggt

SEQ ID NO: 30142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggcggctaagtagttacgcgttgtgggg

SEQ ID NO: 30143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggcgggagttttctctctcacttgacca

SEQ ID NO: 30144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggcgtcaagataaagagcaactaggggt

SEQ ID NO: 30145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggcgtgagcttctgggccagtacttgtg

SEQ ID NO: 30146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggctcgcgtcttcggtctctgtccacca

SEQ ID NO: 30147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggggaagtgatggctcgggtcatcgcacg

SEQ ID NO: 30148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggggacaccgttcattggatgcctaattg

SEQ ID NO: 30149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggggagtgagtaggaaaatattggtgtct

SEQ ID NO: 30150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggggatatcgcatgttcggcagccaggtt

SEQ ID NO: 30151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggggcatggtggcttgtagcgtcgccgtc

SEQ ID NO: 30152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggggcttggtcatgttacgatggtccggt

SEQ ID NO: 30153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggggaacacgatgcactggggtatgtgc

SEQ ID NO: 30154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggggccgcggacgaggatgtggattcgg

SEQ ID NO: 30155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggggcctgcgttcgacaggtgctggagg

SEQ ID NO: 30156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggggggacgtgtccaaatcgggcgttatg

SEQ ID NO: 30157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggggggaggctggggtccacgcttcccgg

SEQ ID NO: 30158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggggttagtctctaacacgggttgctgt

SEQ ID NO: 30159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggggtaagcactttttacgccaacatagt

SEQ ID NO: 30160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggggtgtcttgtgtaagtcgttggaggcg

SEQ ID NO: 30161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggggtttgacgcctaaatggcggcttcta

SEQ ID NO: 30162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggtactaacgccagtatatcgttggcta

SEQ ID NO: 30163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggtatgccccgaacgggagaacagccct

SEQ ID NO: 30164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggtatgcggattagcgtacatgcagtta

SEQ ID NO: 30165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggtcggggtcttcatcatgtgtctacct

SEQ ID NO: 30166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggtgctagtgaccggagtagtaacgcac

SEQ ID NO: 30167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggtggccacgttggaagtatgcatgggg

SEQ ID NO: 30168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggtggctcgatcggctgcccgatacgcg

SEQ ID NO: 30169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggtggtaaagaagggcactgcgatcacg

SEQ ID NO: 30170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggttacgtgcatcacgcatcgttctctt

SEQ ID NO: 30171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggggttggaagagggggagatcttgtatcg

SEQ ID NO: 30172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtaaaaagatattcggggtatctagtgt

SEQ ID NO: 30173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtaaaaagcttgaccaataggttaaagg

SEQ ID NO: 30174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtaaaatattgtgttgtcctacggctgt

SEQ ID NO: 30175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtaacaggcatcgcgcacgagctcggca

SEQ ID NO: 30176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtaagtgggacaacctttatgctccgaa

SEQ ID NO: 30177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtaatgtgtatcagtttgtcccgttgtg

SEQ ID NO: 30178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtacgaatagtaagtggcgacttccgga

SEQ ID NO: 30179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtacgtggcacgggcacttagagtgtgg

SEQ ID NO: 30180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtactggttggtggcgttgtatgtcccg

SEQ ID NO: 30181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtaggccgcgttgctacacgcatattgc

SEQ ID NO: 30182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtaggtgcaagcggtcgctattgctcta

SEQ ID NO: 30183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtagtggcacaaaatgcccccgcttgcg

SEQ ID NO: 30184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtatcgtgcatgggtcgggcacacacga

SEQ ID NO: 30185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtcataggtgaactggaagtatagggac

SEQ ID NO: 30186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtccataccgacgacccgcggcggatgg

SEQ ID NO: 30187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtcccgacggaacatcgtcatggactgt

SEQ ID NO: 30188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtccggtaatcgctcccgtgcggtgaac

SEQ ID NO: 30189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtccgtctagaattgccctatgttcgtg

SEQ ID NO: 30190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtcctaagatggggcacgcgatgaccgg

SEQ ID NO: 30191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtccttcgagcctactgggtaactgttc

SEQ ID NO: 30192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtccttgacttgtcgttctttagaggtt

SEQ ID NO: 30193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtcgacaccacgtccgccagctgttgtt

SEQ ID NO: 30194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtcgctctcccagagctggttcggtttg

SEQ ID NO: 30195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtcggcgacgggggcccgtgacacacgc

SEQ ID NO: 30196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtcggtgcgtcgtgaactcattgtcgtt

SEQ ID NO: 30197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtctatgttagttgcacaggttaggttg

SEQ ID NO: 30198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtctatttgttgatttcgggaatagatc

SEQ ID NO: 30199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtctcgcgattggaacgcacatctctcg

SEQ ID NO: 30200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtctgaatgtagtattaggaatagataa

SEQ ID NO: 30201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtgcaatgacaactgttcgtatcgtgcg

SEQ ID NO: 30202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtgcagcaaattagttggcctggttgct

SEQ ID NO: 30203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtgcattcgctgccgatgtcttatcaca

SEQ ID NO: 30204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtgcgcagcgggtacgtcggttgagtgt

SEQ ID NO: 30205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtgcgcggggatgattgatcgttacctc

SEQ ID NO: 30206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtgcggtgatgatcactcttgggacggc

SEQ ID NO: 30207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtgctggaaaggacaggtgttcgcggat

SEQ ID NO: 30208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtggacatggcccggtaaattcggcggc

SEQ ID NO: 30209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtggcctactacggctgaatgtgcgttc

SEQ ID NO: 30210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtggctgtgctcagatgcggaattgacg

SEQ ID NO: 30211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtggtacagggcttgctcaggcgttgat

SEQ ID NO: 30212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtgtaggaatagcgctattgtgtggtgg

SEQ ID NO: 30213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtgtccaaggagaacatcccaagacgtg

SEQ ID NO: 30214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtgtccgcagggattctgtctatatact

SEQ ID NO: 30215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtgtcgggcaagataacgtatttctgtt

SEQ ID NO: 30216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtgtgcgcggtagggtgggttcattggc

SEQ ID NO: 30217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtgtgtgcatgtatgttttggttgctcg

SEQ ID NO: 30218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtgtgtttggacgtcatatgcaggagtt

SEQ ID NO: 30219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtgttgcggcagaaatatgagttgctct

SEQ ID NO: 30220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtgttgctctagggcctttaacggtgcg

SEQ ID NO: 30221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggttaaacgtctcgggctattgttgcgca

SEQ ID NO: 30222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggttacggcacatgccctttcatgcgtcg

SEQ ID NO: 30223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggttcggtctgtcggcgggcatcgtaaca

SEQ ID NO: 30224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggttgcaggcggtgctgtcatgtagggtc

SEQ ID NO: 30225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggttgctcaaaatatagtcatttatagcc

SEQ ID NO: 30226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggttggcagcgattcctcgacgcgacggt

SEQ ID NO: 30227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggttgggtctcaacgcgcgctcgacatat

SEQ ID NO: 30228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggttgggttgagtttgatgttggctgctt

SEQ ID NO: 30229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtttcggcaatgggtaaggctagtttgg

SEQ ID NO: 30230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggggtttctggcggtttctaaattcggcgag

SEQ ID NO: 30231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtaacgcgtcaatatccagcacgtggttg

SEQ ID NO: 30232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtaagtggcgatattacccaggatctcgg

SEQ ID NO: 30233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtaatccacatttgctgggggttttgggc

SEQ ID NO: 30234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtaatcgaaggagtcccgggcagggtagt

SEQ ID NO: 30235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtacaacgtcgagcttatgcgttaaatat

SEQ ID NO: 30236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtacagtggccgtcatttgtctaaagggc

SEQ ID NO: 30237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtaccaagttttcgaaggacacgatgtgg

SEQ ID NO: 30238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtaccattccggaactggtggtttaggtt

SEQ ID NO: 30239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtacccttttgctagtgactgacccaagc

SEQ ID NO: 30240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtacggaactctcacggacactttcagaa

SEQ ID NO: 30241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtacggaccgttacgattcgccgactcat

SEQ ID NO: 30242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtactcctaactggtttgcacatcttcga

SEQ ID NO: 30243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtacttgagactagcacattatgctgcgg

SEQ ID NO: 30244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtacttggtcgagttactgctaaaggtta

SEQ ID NO: 30245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtagcagtcttaacgtcttcgcgtgccac

SEQ ID NO: 30246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtagcgagtgtcggtgggcatggttgggc

SEQ ID NO: 30247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtagcttactagtttttaactactcatct

SEQ ID NO: 30248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtaggctggcggctgttgcagtaatcaca

SEQ ID NO: 30249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtataatgcggctgctaataagggttcgc

SEQ ID NO: 30250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtatactggatccttttcattgggcaatg

SEQ ID NO: 30251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtatcaatcgagggcacgcgggagctgga

SEQ ID NO: 30252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtatcagcaactcaatgactcctatgaat

SEQ ID NO: 30253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtatcgactctagagacgcgaaggttaca

SEQ ID NO: 30254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtatcgagaaagtgagggtacgtgggtcg

SEQ ID NO: 30255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtatggttggcatcggtaatctggccagt

SEQ ID NO: 30256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtattagagtccgatggtgctgtacgtga

SEQ ID NO: 30257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtattagcagctatctacatatatacgaa

SEQ ID NO: 30258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtattgattcgatcgctcactgacgctgt

SEQ ID NO: 30259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcaaatgcgctgcaaaatcatggtatag

SEQ ID NO: 30260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcaacgtggtccgggtatcctagatggc

SEQ ID NO: 30261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcaagagctgttatgcgcatctttcgtc

SEQ ID NO: 30262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcagaaagcttgcggagtctcgttctgg

SEQ ID NO: 30263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcagaggggcattcccggtaccgctcca

SEQ ID NO: 30264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcagatgataagtatacggcgctccgat

SEQ ID NO: 30265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcagatggggcaaccccttcgctgtgcg

SEQ ID NO: 30266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcagcagcgaaacaaccttcggtccgag

SEQ ID NO: 30267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcagcataatgatctggattccctcgat

SEQ ID NO: 30268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcagtcggtagcggctcaatgatgtttg

SEQ ID NO: 30269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcagtgggtatcgttctgtccacaccgt

SEQ ID NO: 30270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcatatattctccgtcccacgatcgtcg

SEQ ID NO: 30271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcatcggggattagtattaaccaggccg

SEQ ID NO: 30272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcattaactaggtggtctgcatgtggtc

SEQ ID NO: 30273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtccaatcatgccgcccgagctatctccg

SEQ ID NO: 30274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtccctacaggttattacccgggctgcta

SEQ ID NO: 30275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtccgaggtagtaacctaggcgtaacggt

SEQ ID NO: 30276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcgagcctttgtgcctttagttgacatg

SEQ ID NO: 30277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcgatctccgggaacggcaaggagcgcc

SEQ ID NO: 30278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcggctgggtaaactcttgcagctcgcg

SEQ ID NO: 30279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcgggccaggcttgtgcagctcgattgg

SEQ ID NO: 30280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtctaggtccgaggctacatgaaggtgtg

SEQ ID NO: 30281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtctcctccatcctaacgtgccggtggct

SEQ ID NO: 30282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtctcttaggaatccaacgagctcaccct

SEQ ID NO: 30283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtctgacgtactgccaaccctgctagcac

SEQ ID NO: 30284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtctgtctgggatgtaaacggtcatcagt

SEQ ID NO: 30285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcttgcagcgagaacagaggatgccagc

SEQ ID NO: 30286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtcttggggttgtggggtcttatgtggtt

SEQ ID NO: 30287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgaaataaacgggccattggtaaagcga

SEQ ID NO: 30288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgaagggcccgacgatctggcaatctcg

SEQ ID NO: 30289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgacctggtttcgaccagaggagtcttg

SEQ ID NO: 30290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgactcattagcacctatgacagctaag

SEQ ID NO: 30291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgagtagtgaccacgttgtcgtatgcga

SEQ ID NO: 30292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgataatctttcgcattacggtgttctg

SEQ ID NO: 30293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgcactcatttccggtaattagccagag

SEQ ID NO: 30294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgcgaggcacactgggagaagtcgagtc

SEQ ID NO: 30295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgcgcagcgcgccgagtcgagatgtcgc

SEQ ID NO: 30296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgcgcagctttccacggtcgtcaccacc

SEQ ID NO: 30297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtggactcggtggataggtacctcaacat

SEQ ID NO: 30298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtggaggcgagagttactggcacattggc

SEQ ID NO: 30299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtggatacgaactggcagggcgtgatacc

SEQ ID NO: 30300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtggcaaactaagtagcaacggtgaatgc

SEQ ID NO: 30301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtggcgctcgacattcttggtactggtgt

SEQ ID NO: 30302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtggcgtgtgcgaaagtcccgtgtcccga

SEQ ID NO: 30303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgggacagggttggagtaagcaggcgat

SEQ ID NO: 30304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgggatttgctatgagagatatgcttaa

SEQ ID NO: 30305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgggtggagtatggaccacgacatgagc

SEQ ID NO: 30306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtggtcagcttggtatgctcaatgaccta

SEQ ID NO: 30307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtggtctgctctcggcaggtgacacgtca

SEQ ID NO: 30308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtggtcttcgtctcaatttgacattagtt

SEQ ID NO: 30309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtggttcgagggtaccatactccgagttt

SEQ ID NO: 30310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgtaaccgacactccccgacgtagatcg

SEQ ID NO: 30311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgtcacactttgttcgggcaagagattg

SEQ ID NO: 30312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgtcggataggtgtgtcccggccaggtt

SEQ ID NO: 30313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgtgacacgctccagggagtcaggtccc

SEQ ID NO: 30314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgtgccacatgctccaatggtgttgttc

SEQ ID NO: 30315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgtgtccggtaatagcgacagtttgatc

SEQ ID NO: 30316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgtgttatcccaagctgacgcccgaaac

SEQ ID NO: 30317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgttatgctgttgacggaatctggactc

SEQ ID NO: 30318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtgttcccttgataaggggcgtcactttt

SEQ ID NO: 30319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttaacaaagacacgagagtaagcttgtt

SEQ ID NO: 30320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttaagcgactcgggtgcggtgctcattc

SEQ ID NO: 30321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttaccacgtcgtgtaacgtataactccc

SEQ ID NO: 30322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttacggggtacggtgtgtgtggagttgg

SEQ ID NO: 30323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttagctccctctccattgccccatgttg

SEQ ID NO: 30324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttaggcggcttgaattagcagggtcatg

SEQ ID NO: 30325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttaggtgcctatctttcgtggggcgtgg

SEQ ID NO: 30326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttagtcgattcccggctctttgttattt

SEQ ID NO: 30327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttatggggcgcggtgccgacggtctgat

SEQ ID NO: 30328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttctcatacttccaggtcctcgaggacg

SEQ ID NO: 30329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttgcacagttccggaacccaactcgagc

SEQ ID NO: 30330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttgctggtatacaacttttgggagcctg

SEQ ID NO: 30331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttggcgaagcgatatggtcggggtttag

SEQ ID NO: 30332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttggcttcagtactagcgtcctaacaga

SEQ ID NO: 30333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttgggttttagatgacggttccagttat

SEQ ID NO: 30334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttggtcgccgtagcctgcacttcgtttt

SEQ ID NO: 30335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttgtgaagggccatggggccggcattga

SEQ ID NO: 30336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttgtgcactttaccgcatgacggtcgcc

SEQ ID NO: 30337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtttaaggtgtagagcgcgtatgatgacc

SEQ ID NO: 30338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtttagatggggtagccagcaacgcgtgt

SEQ ID NO: 30339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtttcacagttgtaagtttcactttgcga

SEQ ID NO: 30340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtttccgttccgggctctacctgcttaga

SEQ ID NO: 30341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtttcgagacacattgcgtgtaggattga

SEQ ID NO: 30342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtttcgattcggcactcttgattcaccgt

SEQ ID NO: 30343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtttcttacttaacgtcgtgttcacttcg

SEQ ID NO: 30344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtttgcctatgataggtttcgccggagcg

SEQ ID NO: 30345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtttgcttatatacggtgggccagccaca

SEQ ID NO: 30346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtttgcttcggggttaatcaagctatcac

SEQ ID NO: 30347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtttggtggtttgacaggggggctccacg

SEQ ID NO: 30348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggttttatgagacatcaacacatatgccgt

SEQ ID NO: 30349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgggtttttgttgagttggcggaatgctgggc

SEQ ID NO: 30350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaaaccctgcatgatagccgtcctccttc

SEQ ID NO: 30351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaaagcgggaacacctccgagacttgtgc

SEQ ID NO: 30352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaaagcgggatactttatggacacgggat

SEQ ID NO: 30353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaaataattccgcggctaaggtgacgagt

SEQ ID NO: 30354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaacactccttcttggaggcgagggttat

SEQ ID NO: 30355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaacagggggaagttaagggtcctcgctt

SEQ ID NO: 30356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaacggacccccggcacgttgtttggttg

SEQ ID NO: 30357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaacggatgtgatagtgctttgtggttgt

SEQ ID NO: 30358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaactcatggccgcgtaaggtcggcagat

SEQ ID NO: 30359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaagcacgcgacgtactctatcgtgtttt

SEQ ID NO: 30360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaagcctggaatgtttttcggacaactgg

SEQ ID NO: 30361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaaggcaatcgacctgtcgttccatcggt

SEQ ID NO: 30362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaaggcagtgtgatggttcgagacacggg

SEQ ID NO: 30363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaagtggcgtttagcgagtgttgccaatt

SEQ ID NO: 30364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaataggtgacaaggcgacaggcactcgg

SEQ ID NO: 30365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaatcgaagttgtctttttcagttcgcag

SEQ ID NO: 30366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaatgccgttgcatcgtgactgtgctgtc

SEQ ID NO: 30367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaattaacaatacgggcatcgacaaggtt

SEQ ID NO: 30368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtacaactagcgattgaggattcgactggc

SEQ ID NO: 30369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtacacacgtcgaagaggagcagtcagtgc

SEQ ID NO: 30370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtacacggggggttacgaattcccgcgggc

SEQ ID NO: 30371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtacatcggtcagattcctggctttctgtc

SEQ ID NO: 30372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtacatctaggcgcacaattgatgcctccg

SEQ ID NO: 30373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtacatggccgctgttacccgcgaatacgt

SEQ ID NO: 30374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtacccgggccgtgaaaggaactaatagtg

SEQ ID NO: 30375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtacccgttaaacgtcctgcggcggctgat

SEQ ID NO: 30376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaccctgttgggtcagtcttgcaatctca

SEQ ID NO: 30377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaccgctacattagcccggagctggtcaa

SEQ ID NO: 30378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaccggtcaacatatcttacgtgagtaca

SEQ ID NO: 30379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaccggtggcgacagcactggggcttacg

SEQ ID NO: 30380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtacctggcgttcaacgtgcgggtccagtg

SEQ ID NO: 30381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaccttatcagacgtaaaccgtttgtgtg

SEQ ID NO: 30382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtacgacgttgatggctccgttttgatcat

SEQ ID NO: 30383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtacgcaacccgcacacacttccggtttgg

SEQ ID NO: 30384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtacgccgtaacttgcaaatcagtcaggag

SEQ ID NO: 30385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtacgggagcttcaacattcgtcacactgg

SEQ ID NO: 30386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtactagagcggctctgggatatacgaacg

SEQ ID NO: 30387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtactcaaatagacattcattcagtgcagc

SEQ ID NO: 30388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtactcctgagcccgatagcttagctgctg

SEQ ID NO: 30389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtactggtatattccggttgaccagcgttt

SEQ ID NO: 30390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtagacgaaacacatacttcagcgtgtggg

SEQ ID NO: 30391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtagacggccaaccggctctgaactggaac

SEQ ID NO: 30392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtagacgttgcgggttatcagcttatccgg

SEQ ID NO: 30393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtagagcgcgccaaagctggatgacgtgtg

SEQ ID NO: 30394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtagcatgactcagagcgtggcagggggag

SEQ ID NO: 30395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaggagcgttcatctgatgtctgcggtat

SEQ ID NO: 30396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaggaggaaacgacttctagatcttgggc

SEQ ID NO: 30397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaggcaatgccgcgaccttcttgtgtctc

SEQ ID NO: 30398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaggggaggggtgacatacgtgggagtac

SEQ ID NO: 30399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtagggtacgcagcccgtcgcgttgccttg

SEQ ID NO: 30400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtagggtggtgcacgaaatggccccttgcc

SEQ ID NO: 30401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtagggtgtattttttctatgaactgagcg

SEQ ID NO: 30402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtaggtccatctcccccggatgcgtctggt

SEQ ID NO: 30403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtagtactggtcactgagtcggaatccccg

SEQ ID NO: 30404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtagtgaagcggtgattgtacatcactcac

SEQ ID NO: 30405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtagtgtagtagtggtcatgcacggcggga

SEQ ID NO: 30406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtataccacacttaggcattcgacctatgt

SEQ ID NO: 30407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtatactattgtcctctctgggttcgacga

SEQ ID NO: 30408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtatagcgtcccctagttccacatcacgtc

SEQ ID NO: 30409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtataggctcgagaccttccgtccccgtct

SEQ ID NO: 30410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtatcagggttacatccattgttgttgcgt

SEQ ID NO: 30411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtatcaggtgacgacgggtaatccgactgc

SEQ ID NO: 30412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtatccgagggcaacataggaatctcgaat

SEQ ID NO: 30413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtatcgaacgcttattgagatctcttcgtg

SEQ ID NO: 30414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtatcggaggcccactcttcggacaatata

SEQ ID NO: 30415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtatcgggcaacgtctgtacggaaagcaga

SEQ ID NO: 30416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtatcgggggtaactacgctcaattgatcc

SEQ ID NO: 30417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtatctggggtacacctagcgtccggggta

SEQ ID NO: 30418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtatgactcagagccaattcaaccgcgctg

SEQ ID NO: 30419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtatgcaggatccaggcctcatgcccaaga

SEQ ID NO: 30420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtatggcacattgcgtatgacaacccaaac

SEQ ID NO: 30421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtatgggtctcatctacggtgggtaagcgt

SEQ ID NO: 30422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtatggtgtctgggtttcggtggaataccg

SEQ ID NO: 30423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtatgtaagccatcactacttcagcgggtc

SEQ ID NO: 30424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtatgtcatccgatttctcggcttccgcta

SEQ ID NO: 30425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtatgtgctccggcgggcctattataagta

SEQ ID NO: 30426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtattcctctgcggatgggacttctgggca

SEQ ID NO: 30427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtattccttgaacgtgcagatcggacactg

SEQ ID NO: 30428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtattggtgctgtttcgattctggcggcgc

SEQ ID NO: 30429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcaaatgccgggagggtggaagtggggtg

SEQ ID NO: 30430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcaacggactcaccacggtagtctaaccg

SEQ ID NO: 30431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcaagcgaacgaccccggtatcgtggtga

SEQ ID NO: 30432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcacaagcggggccagagccactgtttcc

SEQ ID NO: 30433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcacacgagtacacattactaggtggcgg

SEQ ID NO: 30434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcacaggtggtaggttggtcgctcaccct

SEQ ID NO: 30435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcaccaccagtcgtctggaatctgctgcc

SEQ ID NO: 30436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcacctacgttcaccggaaaccgcagtgc

SEQ ID NO: 30437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcacgcaacaacgtctagtttgctactcc

SEQ ID NO: 30438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcacgcacggctgctagggcgttgcaccc

SEQ ID NO: 30439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcacgttgctttttgtgatcaagcacggg

SEQ ID NO: 30440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcactagagactccgtgcggacgtcctat

SEQ ID NO: 30441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcacttagccaccgccctttcttacgcgt

SEQ ID NO: 30442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcacttgccccctcgttgttattccagac

SEQ ID NO: 30443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcagactaacgagtcaccaagcccgctgc

SEQ ID NO: 30444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcagagagagcgattccctgctaggctac

SEQ ID NO: 30445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcagcacattaggcaagatctgcgtacct

SEQ ID NO: 30446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcaggacaactacgtctgggaatcatgct

SEQ ID NO: 30447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcaggatctgtgccggttgtccggagatg

SEQ ID NO: 30448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcagggctctagcgcacctgattatacct

SEQ ID NO: 30449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcagtaccggtgtgcactgggcgatgtcg

SEQ ID NO: 30450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcagtacgatcttgtgttgttagatggga

SEQ ID NO: 30451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcataaaggcacgggacactctaggttac

SEQ ID NO: 30452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcatagatggccgtatgctaatagcgaca

SEQ ID NO: 30453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcatcggtgccctgattggcctcctcctg

SEQ ID NO: 30454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcatctgccttagctgctggtttgggagg

SEQ ID NO: 30455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtccacgcggcctgaagaattctcccggga

SEQ ID NO: 30456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtccatgcatacggagaccgctcttatgat

SEQ ID NO: 30457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtccattggtatgggtccaattgggatggc

SEQ ID NO: 30458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtccattttcagagttgtgatgtcttgcgg

SEQ ID NO: 30459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcccagagttcggggctacgcgtagtggg

SEQ ID NO: 30460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcccatggcaaggacagacaaacgttgac

SEQ ID NO: 30461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtccccatcgatgctgtatcgtctaccgat

SEQ ID NO: 30462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtccccattaaccggtcgcgtcgcaacgat

SEQ ID NO: 30463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcccctcgcgtcatcacctaattcggcta

SEQ ID NO: 30464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcccgcgggctaggctaatatcgaagatc

SEQ ID NO: 30465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtccctgtgcagttactttccgcccctttt

SEQ ID NO: 30466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtccgacgagcaaccacggcaccggttttc

SEQ ID NO: 30467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtccgagttttcgggaaggtgatagtttgt

SEQ ID NO: 30468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtccgatactgtcgctttactcgtgtcacc

SEQ ID NO: 30469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtccggaagcgatgcatgcagacgaatttg

SEQ ID NO: 30470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtccgtgggcactcgtattatgggggttgg

SEQ ID NO: 30471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcctaaagggcaacgtgtatgctcacctc

SEQ ID NO: 30472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcctccccgtcactccccacttaagtatt

SEQ ID NO: 30473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcctcgcacgtcatttgcggcaatgtcgg

SEQ ID NO: 30474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcctggaggtaagcgatagatgaaaacta

SEQ ID NO: 30475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtccttcgtctatcatctaggactcgcacc

SEQ ID NO: 30476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcgacagtaaggattcgcagttcacaacc

SEQ ID NO: 30477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcgacgcctgtcccgtaggaatgggcgag

SEQ ID NO: 30478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcgatcgggctacccggcaatctttcgtt

SEQ ID NO: 30479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcgattggctgactttagttcggttctat

SEQ ID NO: 30480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcgcaatagcaaatggggacgcggcaaga

SEQ ID NO: 30481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcgcagcccttgagtctctataaccggcc

SEQ ID NO: 30482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcggacggatttgatggatgcacacctga

SEQ ID NO: 30483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcggagtcgtttttgtgaggagcttaatt

SEQ ID NO: 30484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcggagtgctgtgcccattacgttaacct

SEQ ID NO: 30485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcggccggaattagctaccaacgggatat

SEQ ID NO: 30486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcggtgaagtccccatcagcttaccttta

SEQ ID NO: 30487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcgtactgcatgctaaggggctcactccg

SEQ ID NO: 30488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcgtcacgatccggaacaagtgatgcgcg

SEQ ID NO: 30489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcgtctgtgacgtagctggtcgattggcc

SEQ ID NO: 30490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcgtgatgaacatgaagctcttgatgtgg

SEQ ID NO: 30491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcgtgcgcctgatgtgcaactggatcctg

SEQ ID NO: 30492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcgtggccgaattctacacgcgccaagcg

SEQ ID NO: 30493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcgtgtgtcattgtttgcctctgttgatc

SEQ ID NO: 30494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcgttccccctcagagccgtgtatgcagc

SEQ ID NO: 30495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcgttgcgtccgaaacttgatcgaatgtg

SEQ ID NO: 30496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtctacattaggctttcttcctgggtttgc

SEQ ID NO: 30497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtctacctcgttaactgtaataacaacttc

SEQ ID NO: 30498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtctacgaagttccacttgatgcagaacac

SEQ ID NO: 30499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtctagggagctccggagtcttcgtgccat

SEQ ID NO: 30500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtctagtgcaatcgtgggctctgtttgtac

SEQ ID NO: 30501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtctcggctttcgtcagaattcctgcttgg

SEQ ID NO: 30502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtctgacttgctcttctgcttgtgcctctt

SEQ ID NO: 30503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtctgagggattttccgggactgattggaa

SEQ ID NO: 30504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtctgcacgtggactaccgcgcactttcgc

SEQ ID NO: 30505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtctgcgccatcagtacaatcggtcgcggc

SEQ ID NO: 30506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtctgcgtgtactctctgcgcgttatctac

SEQ ID NO: 30507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtctgctggataataacgctagtagccgta

SEQ ID NO: 30508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtctggcttcaaaggtgcgaaaccggaagg

SEQ ID NO: 30509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtctgggaaatgaattagaagcttttgcgg

SEQ ID NO: 30510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtctggggaccaacattatgctcgtcatgg

SEQ ID NO: 30511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtctggttggtttagagacactctggagcg

SEQ ID NO: 30512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtctgtagcccctgagcatatatggagcct

SEQ ID NO: 30513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcttaaggtttgccggttcattaacgcgt

SEQ ID NO: 30514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtcttgcacggagcgttttaaccaggctgt

SEQ ID NO: 30515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgaaacgagccatccagattcagcgtgac

SEQ ID NO: 30516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgaacgcccggttggttattgttggctcg

SEQ ID NO: 30517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgaagcgggagaagtcatgtcaagtctat

SEQ ID NO: 30518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgaataccagtcatgatcgtacgtgactg

SEQ ID NO: 30519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgaatatcacatgctgcccgacgctcagt

SEQ ID NO: 30520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgaatgtaagtatcgtccggcaacaccgg

SEQ ID NO: 30521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgacaatcgatttgttttcgtatccacct

SEQ ID NO: 30522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgacacgtcatgatgaatatcgaggcgtc

SEQ ID NO: 30523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgacagcggaggtccttgggcgccccttg

SEQ ID NO: 30524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgacccacggccagggagtggcgttgggg

SEQ ID NO: 30525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgaccggagatcagccggactaatcatct

SEQ ID NO: 30526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgacctatgtagagggatgcgaggaaaat

SEQ ID NO: 30527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgacgcgacatcgtttgcggttttaggtg

SEQ ID NO: 30528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgacgggtggcggagtttatgcgaaggtg

SEQ ID NO: 30529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgacgtcaactaatccaaggggcagtctt

SEQ ID NO: 30530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgacttcggcttccggggaggttttttct

SEQ ID NO: 30531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgagacgcatgtgactgtgctgggttgtc

SEQ ID NO: 30532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgaggaatcttgagatcacttcggggggc

SEQ ID NO: 30533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgaggacatgaaatgcgaagacgtctccc

SEQ ID NO: 30534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgaggtctcgtgcgtgaatgataattctg

SEQ ID NO: 30535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgaggtttggtcatggacccgggggttag

SEQ ID NO: 30536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgagttagtgacgccgcaagaagttcgtg

SEQ ID NO: 30537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgatgcacaccttcatcgtcttcggacac

SEQ ID NO: 30538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgatggcagtagtcaccggtgaatcctct

SEQ ID NO: 30539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgatgtttgatgtaggaggctggcgctgc

SEQ ID NO: 30540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcaagcggagggctgcatatgctcagtc

SEQ ID NO: 30541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcacacggatgttcacttaattgaggcc

SEQ ID NO: 30542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcactgattgttgtggatcttttggtgt

SEQ ID NO: 30543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcagcatgcatccctcggtaccgtgcgc

SEQ ID NO: 30544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcaggacatttgtgcaaatcggctcatc

SEQ ID NO: 30545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcaggcgaagcaacgtaaatgtaagtcg

SEQ ID NO: 30546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcaggtcgcagctctaccctcggtcgcg

SEQ ID NO: 30547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcatatcgaggctggctggtggtgtgcg

SEQ ID NO: 30548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcatatttataagtccggcgcggcacga

SEQ ID NO: 30549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcatcaattcaaagcagagaacgtctgt

SEQ ID NO: 30550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcatgcggatgtgccccttcatgaatgg

SEQ ID NO: 30551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcatggggcgttgtgagctgggctgcat

SEQ ID NO: 30552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcatggtctcaatagtgcggatgcctcg

SEQ ID NO: 30553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgccagttatggggaaaggtgacgctgat

SEQ ID NO: 30554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcccaaacggtccgaattcaaaaggacg

SEQ ID NO: 30555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcccaaggttgctcccttaatcggtgcg

SEQ ID NO: 30556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcccaagtgacttttcatcctctagcga

SEQ ID NO: 30557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgccgacgcgaaatactaaccggagtctg

SEQ ID NO: 30558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgccggtcacttcctgatgcgcttactct

SEQ ID NO: 30559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcgcgcagccggtgttcaggggttagca

SEQ ID NO: 30560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcggaatacgcccaggtgagttctgatt

SEQ ID NO: 30561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcggaccagcagtcgtttcaacgcgtcg

SEQ ID NO: 30562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcggacgggggtttcaccttatggttgc

SEQ ID NO: 30563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcggctgaggtgtggtattttaccacct

SEQ ID NO: 30564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcgggagtccagaagatatgcaattctt

SEQ ID NO: 30565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcggtccgtcttccaatcttgcatgtat

SEQ ID NO: 30566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcgtaagtttgccccggtccaggtgttg

SEQ ID NO: 30567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcgtacatgggggtaaaggccctgggcc

SEQ ID NO: 30568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcgtcattgaaaacgactactggaaggc

SEQ ID NO: 30569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcgtgctttcagatggccggtcaagtgc

SEQ ID NO: 30570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcgtgtcatgagaacttaggggtttccg

SEQ ID NO: 30571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcgttaatctgggggatggtggctcgcg

SEQ ID NO: 30572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgctatggtcttaaacgtatttacggttt

SEQ ID NO: 30573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgctccaatcgagatgagcagctgtctcc

SEQ ID NO: 30574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgctgctggtaaagcgacgtgtgaatgta

SEQ ID NO: 30575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgcttgcatgaatccgtgtcgacctggtc

SEQ ID NO: 30576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggaatacgaatgaaggtgcataaccgta

SEQ ID NO: 30577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggacccgaacgctgttctttcgtgttag

SEQ ID NO: 30578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggacgggaggcggccttgtgtgtccgta

SEQ ID NO: 30579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggaggggtttggctacgtttgggaccga

SEQ ID NO: 30580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggagtagctggcccctcatcctgtttcg

SEQ ID NO: 30581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggatatgcgaggacatgcttacgtttgg

SEQ ID NO: 30582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggatgtcaacttccacttaatgacgttt

SEQ ID NO: 30583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggatgtgtgcgttgatcgctgagcaagg

SEQ ID NO: 30584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggattgtattcatgctggtatgcagaat

SEQ ID NO: 30585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggcaagcgctacgttatcagcagtgttg

SEQ ID NO: 30586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggcagtatgacgggtaacacacactacg

SEQ ID NO: 30587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggcatggctcaggtatcactcagcgtac

SEQ ID NO: 30588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggccaatagggtcactcaattcgaagta

SEQ ID NO: 30589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggccgttcttcttttagggaaatgctcg

SEQ ID NO: 30590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggcgagtcggttgatcctgacaatgatg

SEQ ID NO: 30591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggctcaatgcagatctactccccatctc

SEQ ID NO: 30592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggctccggatataagccatgtgcaatgt

SEQ ID NO: 30593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgggaggttgccatgatacaagcgctggg

SEQ ID NO: 30594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgggccagaaagtgtctcgctgtcggcgc

SEQ ID NO: 30595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgggcccatggaataatgatagtccactc

SEQ ID NO: 30596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgggcggtggatggagggggctctgactc

SEQ ID NO: 30597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgggctcaagtgcgaacccaaaaggtgtc

SEQ ID NO: 30598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggggaatgattcctctatgttccttgtc

SEQ ID NO: 30599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgggggcaggtcgtcgcgtaaccaccgcg

SEQ ID NO: 30600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgggggctcttcactgttgtccacatgag

SEQ ID NO: 30601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgggggggctcggttccatgcttggtagt

SEQ ID NO: 30602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggggggtgataaaactctacaactttca

SEQ ID NO: 30603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggggtggcttgcttgcggtcctgacaag

SEQ ID NO: 30604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggggtgtggagatagagtggaggctttt

SEQ ID NO: 30605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggggtttgatcgattcatgctttcttcc

SEQ ID NO: 30606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgggtggtcgacataatgtactagccctg

SEQ ID NO: 30607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggtactccagtcgatcggctgcaagctt

SEQ ID NO: 30608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggtcagagtttacgggaaagtatgcttc

SEQ ID NO: 30609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggtcatcggtgcgtatgaggggctgcga

SEQ ID NO: 30610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggtccagccctttcgaacacccggttgg

SEQ ID NO: 30611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggtcggattccgtaggtgggtatacatc

SEQ ID NO: 30612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggtcggtaagcgctaagtcttgacccgg

SEQ ID NO: 30613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggtcgttggctcttggtgcgacgtacga

SEQ ID NO: 30614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggtgctatcaaactttgctgtcaggtta

SEQ ID NO: 30615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggtggacgtcttcttccgtcgtagagct

SEQ ID NO: 30616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggtgggaatgtcataagcctttagtcac

SEQ ID NO: 30617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggtgggtgtgtggttcggtcgcgggtta

SEQ ID NO: 30618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggtgtatgtaaatggtgccgtgtaagca

SEQ ID NO: 30619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggttagcggtcatctctagaaggcgggg

SEQ ID NO: 30620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtggttgcaggcggtggacctgtttgaccg

SEQ ID NO: 30621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtaaagccatatgctataagctttgacc

SEQ ID NO: 30622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtaagaaagtagtggctggaggcctact

SEQ ID NO: 30623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtaattcttcatgtcaccccagagaatg

SEQ ID NO: 30624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtacacagcatgttgtttcatttaactt

SEQ ID NO: 30625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtacaggagtctggtttggtccaccacg

SEQ ID NO: 30626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtacgctttatgtgttgccttgggacct

SEQ ID NO: 30627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtacgtggatgcacaacctattcattgc

SEQ ID NO: 30628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtagccgctcgaccctctgcgtcccggg

SEQ ID NO: 30629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtaggaatgagactcatgctcattcggt

SEQ ID NO: 30630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtagttagccagagatgattctttgtta

SEQ ID NO: 30631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtatcattacctgacttgctcagttctg

SEQ ID NO: 30632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtatgattgagttgcagtgctttggcct

SEQ ID NO: 30633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtatttggcagcttagtcgagtccaggt

SEQ ID NO: 30634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtcgaaagcagtgagcgttctaagtgag

SEQ ID NO: 30635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtcgccatcacatgcgcgtccttcatgc

SEQ ID NO: 30636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtcgggcaaggccgtaccggatgatggg

SEQ ID NO: 30637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtcgtttccattttacctcggcggacaa

SEQ ID NO: 30638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtctccatacctgtagagccggcttgtc

SEQ ID NO: 30639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtgatgattattgtcttgaatgactcgg

SEQ ID NO: 30640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtgcgccaagacgtatgaatcagagctt

SEQ ID NO: 30641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtgcgggtcattggcgtgtgatcccggg

SEQ ID NO: 30642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtggaggccatcgaggactgcagttgtg

SEQ ID NO: 30643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtgggcgaccatgtacagttaggattaa

SEQ ID NO: 30644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtggggacatgcgtgcgtcctaatggcg

SEQ ID NO: 30645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtggttacctatttcgcgggcagcgtta

SEQ ID NO: 30646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtgtctacaagtcgggagttttatcgtg

SEQ ID NO: 30647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtgttaggccttttagggatcgattgta

SEQ ID NO: 30648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtgtttcatttccggggtgctagattcg

SEQ ID NO: 30649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgttactttgacggagaggccttgacgac

SEQ ID NO: 30650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgttagcgtcgtcctctgcctgtcacagc

SEQ ID NO: 30651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgttcaataatgcttcaatatgttctcac

SEQ ID NO: 30652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgttcagagggtgtaatccggtggatgag

SEQ ID NO: 30653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgttcaggatgcgagccttatgataccta

SEQ ID NO: 30654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgttccggcctgagtgacattggcgttcg

SEQ ID NO: 30655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtgtttgcttgatagtgctcctctcgcacg

SEQ ID NO: 30656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttaacaattccgggcaaccgatcgccgtg

SEQ ID NO: 30657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttaacgcccgggtctccactcgaccgacg

SEQ ID NO: 30658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttacccggtagtaggaatcgctgggcggc

SEQ ID NO: 30659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttaccctcgagcacaagtttgctgcctga

SEQ ID NO: 30660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttacctggactcctccttttatagagggc

SEQ ID NO: 30661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttacgttaagccgatgtgttgcagttctc

SEQ ID NO: 30662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttagacgcagtaagttgaccatcaccaac

SEQ ID NO: 30663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttagaggccaagatgcgatcgagctgact

SEQ ID NO: 30664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttagcatcgaggaccctcggccagcccgg

SEQ ID NO: 30665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttagcgtctatcattaagtaaccaggccg

SEQ ID NO: 30666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttagggggcgggcctgaagtcttcgaagg

SEQ ID NO: 30667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttaggtggtccttccgcgctagtacttgg

SEQ ID NO: 30668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttagtctgcgaggcttatttcgtgccgtg

SEQ ID NO: 30669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttatccagatgtgtcgatcaacgctctgt

SEQ ID NO: 30670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttatcccgtaataactgtgaaacacaagg

SEQ ID NO: 30671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttatcgatgagctttgatacaattaactc

SEQ ID NO: 30672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttatcgcagttgactggcaaagtccgacc

SEQ ID NO: 30673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttatctttctgactttgccacgtctgggc

SEQ ID NO: 30674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttatgcaggtaccgagtcatctattggtg

SEQ ID NO: 30675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttatgctccacgggggattcgcgagggtt

SEQ ID NO: 30676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttatgctcccctcggtggaaagtagtccg

SEQ ID NO: 30677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttatggaccgggtacgcgcttgcccacac

SEQ ID NO: 30678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttattgtcgttttgtatctccgcgtatat

SEQ ID NO: 30679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttcaaagctgtgggtcggtgtgttgggcc

SEQ ID NO: 30680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttcaacgctgtgccatatctgtggtgtgt

SEQ ID NO: 30681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttcaagggaggccgacactgcacgcaagc

SEQ ID NO: 30682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttcaagtggcccagattgaactgttgggc

SEQ ID NO: 30683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttcatctaagattgcctcccgtctgttga

SEQ ID NO: 30684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttccagctttcgttttaccaattggactc

SEQ ID NO: 30685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttccatcaggcatccgtcagtttgcacgg

SEQ ID NO: 30686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttccatggtctgctccactatcgccgttc

SEQ ID NO: 30687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttcccgcttcatctattgctgctagaaca

SEQ ID NO: 30688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttccgacagccaaattggttgtgtggctc

SEQ ID NO: 30689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttccgcttgatcgggtcttgattcggtga

SEQ ID NO: 30690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttcctttaatttgtcgccgatggttcctt

SEQ ID NO: 30691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttcgactacagttcactcgtcccatcacg

SEQ ID NO: 30692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttcggacgtgggccagaggaagctgaacc

SEQ ID NO: 30693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttcggcaatgcgttcattatatcaaatgt

SEQ ID NO: 30694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttcggtttatctcgtcatactgatcctag

SEQ ID NO: 30695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttcgtcctttagtgggatcttggtgggga

SEQ ID NO: 30696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttctatctgtgcgatcaaatcggtctgcg

SEQ ID NO: 30697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttctcccatgactgtcaccgtccctgccg

SEQ ID NO: 30698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttctctgggctactcgatccgcagcgagc

SEQ ID NO: 30699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttctgcctgaggacgatagagtcggtttc

SEQ ID NO: 30700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttctgtttctcttcatcgtaatacatgcg

SEQ ID NO: 30701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttcttatccgtattcgtcgatcttcgttt

SEQ ID NO: 30702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttcttcaagcgattctgacgtacttgccg

SEQ ID NO: 30703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttcttctcattgcgcaggttttcggtcgg

SEQ ID NO: 30704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgaaaatacggtcttcccaatgggctat

SEQ ID NO: 30705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgaaacgaattaagctttgacttattac

SEQ ID NO: 30706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgaattaggggggacaatgacatcggcg

SEQ ID NO: 30707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgaccccctttggattgcgtggtgaaca

SEQ ID NO: 30708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgacttttatgccatttcttgtaacctc

SEQ ID NO: 30709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgagacgtcatccggggaacacattgtt

SEQ ID NO: 30710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgaggggactagtaataccggcatacat

SEQ ID NO: 30711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgatcactgcctcctataaagcatatgc

SEQ ID NO: 30712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgatgcaacggttccgaccactggagac

SEQ ID NO: 30713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgcaccagactaattccctaaggtcggc

SEQ ID NO: 30714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgccgatgccatagcctgtacaacctga

SEQ ID NO: 30715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgcgaggggaggtcacaccgagtttggg

SEQ ID NO: 30716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgcgctatccgatcaaagtcgcgcggtg

SEQ ID NO: 30717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgcggaaacgtgcgtatctttgtgatca

SEQ ID NO: 30718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgcgggtcttgccgagcttttatactgt

SEQ ID NO: 30719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgcgttagtgccatattaggggtccggg

SEQ ID NO: 30720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttggactgaaacgttaattgaacgtcaga

SEQ ID NO: 30721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttggccattccctcgggtgggagtacggg

SEQ ID NO: 30722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttggcgaatccttttgagtatgaatgcgc

SEQ ID NO: 30723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgggacgcgaacgggcgtgctctcggag

SEQ ID NO: 30724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgggagatttggaacatctgcactctac

SEQ ID NO: 30725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgggggtcgcgttcatgttcaatcggtc

SEQ ID NO: 30726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttggtcgagtactcacaattgtcactacg

SEQ ID NO: 30727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgtgcggtgatgccatactgtcggaaag

SEQ ID NO: 30728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttgttgtatcgtaaatctctgctgcgttc

SEQ ID NO: 30729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtttaaaaggacaaagcaggcagtttctgt

SEQ ID NO: 30730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtttagcgatcagcaacgtgcagcggtaat

SEQ ID NO: 30731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtttaggcgcatcccctgacggccgggcca

SEQ ID NO: 30732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtttagtacttacgacctcctgctcaacaa

SEQ ID NO: 30733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtttccccaatctatacgtaacgatctatc

SEQ ID NO: 30734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtttccgatgctacgatatggcatatgacg

SEQ ID NO: 30735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtttcgcgatgcattgttgtttgctctcga

SEQ ID NO: 30736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtttcggttgacatggctccgggttctccc

SEQ ID NO: 30737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtttcttctagcattacattttgtaactca

SEQ ID NO: 30738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtttgccagcaccttatagtcgcactctta

SEQ ID NO: 30739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtttgcggctcaggttgacgactggttcta

SEQ ID NO: 30740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtttggacgatccttgcgcttaacacgacc

SEQ ID NO: 30741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttttcatttcgaatttactagagagcgga

SEQ ID NO: 30742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttttcccaggacattcatcgtgtggcaag

SEQ ID NO: 30743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttttccgcgcgccttctctatatcgtttc

SEQ ID NO: 30744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttttgcaggactataaataaactcccggt

SEQ ID NO: 30745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggttttgctctgaatctatttagggtgcgca

SEQ ID NO: 30746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cggtttttctaccacatagccgggccctcatt

SEQ ID NO: 30747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaaaaggcgcacgcagaccctggccgatgc

SEQ ID NO: 30748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaaacgcttcttgaaattggccgtaaagtc

SEQ ID NO: 30749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaaacggtcattcacccggtctcaaggcgt

SEQ ID NO: 30750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaaagatcgccgcccctatcatagaagggt

SEQ ID NO: 30751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaaagcataacttcccgggttctcgagttg

SEQ ID NO: 30752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaaagggtccctggggccagccgtatggag

SEQ ID NO: 30753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaaatcttgcatgggcctttaccgtactgc

SEQ ID NO: 30754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaacaatggttcgaacgctaggcttctcat

SEQ ID NO: 30755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaacacgtaattatctgtccgaggtcagct

SEQ ID NO: 30756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaacaggggtgcttgacattcctcaagtcc

SEQ ID NO: 30757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaacatagacagccgtggctgcgaacagca

SEQ ID NO: 30758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaaccaagcaggctctgccgagacgcggtc

SEQ ID NO: 30759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaaccacgcagctcacccggtttggatcac

SEQ ID NO: 30760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaaccgagcgcttaatgccaatggagcata

SEQ ID NO: 30761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaaccggaattgattaccatctcggaacac

SEQ ID NO: 30762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaacgcaacctcctcgcaccacaggcgtgt

SEQ ID NO: 30763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaacgcagattccttgccagtcacgttggt

SEQ ID NO: 30764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaacgccttgttctgatacggcagtgggcg

SEQ ID NO: 30765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaacgctgctacatgtaggggtgttgatcg

SEQ ID NO: 30766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaacgcttcgtacccaggatggtttttccg

SEQ ID NO: 30767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaacgggctcgagaacttcatgatgtgcgg

SEQ ID NO: 30768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaacggtacggttagctcgccaactctcat

SEQ ID NO: 30769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaacgtagggcctcgcgtaagacttcgcgg

SEQ ID NO: 30770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaacgtgttcgtggccagcatactgagggc

SEQ ID NO: 30771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaacgtttacctcggatgcgaccgagtatc

SEQ ID NO: 30772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaactacatacgttttgtatcgttattgaa

SEQ ID NO: 30773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaagagagatcagttcgtaggatgtctggt

SEQ ID NO: 30774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaagaggtgatgcagtaattcggcagcgaa

SEQ ID NO: 30775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaagatgattacagagtttttcgttaccta

SEQ ID NO: 30776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaagcagctcagatacagtgtctggccctt

SEQ ID NO: 30777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaagccaaccataatctctgttcggtagga

SEQ ID NO: 30778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaagccataggacgcgcgaccgaggcaatt

SEQ ID NO: 30779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaagcgggacttggtactcataacggatcg

SEQ ID NO: 30780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaaggcgctccgaacttagtataacggcgc

SEQ ID NO: 30781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaagggttctgtcagcgcgtccagctggtc

SEQ ID NO: 30782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaaggtccatctcagccgcggccgtccgaa

SEQ ID NO: 30783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaagtcaggcgcacgtcgggtcatggaacg

SEQ ID NO: 30784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaagtttcttgacgtcggggtcaggcatat

SEQ ID NO: 30785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaatagagtgccccacgtccccggttacga

SEQ ID NO: 30786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaatagccccggcccgctctttcagtgtta

SEQ ID NO: 30787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaatatgataaccggggaatgcacttgggt

SEQ ID NO: 30788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaatcccatcatgggcctgcatactgcgat

SEQ ID NO: 30789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaatccgggagcattctggctcgtgcacta

SEQ ID NO: 30790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaatcgttaattccgagcaagcggtctagt

SEQ ID NO: 30791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaatgataatcctgagctacaactgacgtg

SEQ ID NO: 30792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaatgcctcgggataaagcgatattccaac

SEQ ID NO: 30793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaatggcaatacaatgtttttgggaccgct

SEQ ID NO: 30794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaatgtgcttctagtggaaacgacgcaaat

SEQ ID NO: 30795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaattatatatacaagggtgtgcttagatg

SEQ ID NO: 30796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaattcaacttgcaagacgtagagagagcg

SEQ ID NO: 30797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaattgtgcattgcccggtcgtgacgtcgc

SEQ ID NO: 30798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacaacttttgaaattggcagacgcgggcc

SEQ ID NO: 30799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacaagaaggcaggggatctgtccctaaga

SEQ ID NO: 30800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacaagagagctacatttcgcgcggtacga

SEQ ID NO: 30801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacaccacgatttaacgctctcattgttgc

SEQ ID NO: 30802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacaccttgagaattggggtttcgtggcat

SEQ ID NO: 30803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacacgggctttcttgattacaactggggg

SEQ ID NO: 30804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacactcaggttgcctcgtggacggtgcac

SEQ ID NO: 30805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacaggtcacaccggacgatctcatgcttc

SEQ ID NO: 30806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacaggttacgtagaggaagtggttgttag

SEQ ID NO: 30807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacatcctgagtttgacgatctaggttagg

SEQ ID NO: 30808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacatcgacgggtgttgaccggcttaactt

SEQ ID NO: 30809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacatgacccttgattgcagtttgatcggg

SEQ ID NO: 30810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacatgcacactatagtcaattggcgaggg

SEQ ID NO: 30811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacatgggacttaagccttagagttggagt

SEQ ID NO: 30812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacattacccttcggtagttagttcggtgt

SEQ ID NO: 30813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaccaattcacaggtggctgcaaccgcggc

SEQ ID NO: 30814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaccatgggtcgtaagttgctagcgaacac

SEQ ID NO: 30815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacccacttgccaactgtcccttcttcgtc

SEQ ID NO: 30816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacccattatgcgtgggcgtgcgttcgctg

SEQ ID NO: 30817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacccatttgccacgaagtcgcgctaggtg

SEQ ID NO: 30818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacccctgggcacatgcacggccattcgtt

SEQ ID NO: 30819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaccctaaccacgtcccgcttctcgtcctt

SEQ ID NO: 30820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaccctaggagtgcggtgacagtttgcctc

SEQ ID NO: 30821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaccgagttgagctagttacctggacggct

SEQ ID NO: 30822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaccggcctcccgacaaatgcgcgtcacct

SEQ ID NO: 30823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaccgggcaacatcgattcgagagttcgtc

SEQ ID NO: 30824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaccgtccgggaaggttcgatattccggaa

SEQ ID NO: 30825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacctcggcgttggtggaaggcacaaggtc

SEQ ID NO: 30826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacctgcaagtcctggggtcacgttattga

SEQ ID NO: 30827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaccttctatggcggagcggggtggtgcaa

SEQ ID NO: 30828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacctttagagttatattgtgccgattggg

SEQ ID NO: 30829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacgaaggcgatctgacacttatgtccctc

SEQ ID NO: 30830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacgagatgaaacgggtttcgcggatgccc

SEQ ID NO: 30831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacgagcaaataagcgtctgaagggccgcg

SEQ ID NO: 30832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacgagggtgctcctaacttgatccacgtg

SEQ ID NO: 30833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacgataggggctccgggttgtttcggggc

SEQ ID NO: 30834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacgctcgcacacaccgtagaggccacgat

SEQ ID NO: 30835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacggcgatcgagtgcttatcacgactgcg

SEQ ID NO: 30836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacggctccgattcttaattgacggcgtca

SEQ ID NO: 30837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacgggaaagtatggaacccgcttactgtt

SEQ ID NO: 30838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacggggacaataccaccagctgggcaaag

SEQ ID NO: 30839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacgggtgaatatacgacgtgatggctgac

SEQ ID NO: 30840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacggtcgggtgaacagcgtcgagaccctg

SEQ ID NO: 30841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacgtcgaggttggctctctcgggtcatgg

SEQ ID NO: 30842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacgtgtactcacaatatgatttcgcgctc

SEQ ID NO: 30843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacgtgtggggtgcgggaggtaagagtagc

SEQ ID NO: 30844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacgtgtgttttaacttatcttcaacgatt

SEQ ID NO: 30845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtactacctaacttacacaaatcggggatgg

SEQ ID NO: 30846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtactaggagcgggaaaatgacgcgtagccc

SEQ ID NO: 30847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtactatgcgaagggagaagggaggtatacg

SEQ ID NO: 30848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtactattctctctgtaattgcacgtcctgt

SEQ ID NO: 30849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtactattgccattgtcgtacttaatgtcgg

SEQ ID NO: 30850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtactcatcaggccagtgttgacatacctga

SEQ ID NO: 30851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtactccgaggcccccgtggatcaggttgca

SEQ ID NO: 30852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtactccggtaggggttgcttgatcgccgca

SEQ ID NO: 30853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtactgatattgctaccatctcgcaatgggt

SEQ ID NO: 30854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtactgctagggagataggtggacgaggcgg

SEQ ID NO: 30855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtactggattgctagctcacggctcggcatc

SEQ ID NO: 30856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtactggcctgctgtcccgcttggagcgtat

SEQ ID NO: 30857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtactgtaggaagacgatccaatgcctgccg

SEQ ID NO: 30858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacttcagatgggggtgaggcggaatggga

SEQ ID NO: 30859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacttcccggttaaggactgtggccgtatg

SEQ ID NO: 30860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacttggcgaatcctagggtctccgttcgt

SEQ ID NO: 30861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtacttgtcgagactaatggaagacggctgt

SEQ ID NO: 30862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagaacaggggggtactgtaccagcctgta

SEQ ID NO: 30863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagaatccgggtcggatcgtgttgttcaca

SEQ ID NO: 30864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagaatcgagcatgttaatccggcggaggt

SEQ ID NO: 30865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagacccttccactcacgtattacccacgt

SEQ ID NO: 30866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagacgtcgttagcaaaccgtctcgttgac

SEQ ID NO: 30867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagacttaattaattggttcggaggacgtt

SEQ ID NO: 30868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagagacgcacttagcgccagcttttagct

SEQ ID NO: 30869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagagagcgggagtctggcccctgagacgc

SEQ ID NO: 30870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagagcccggagtcagcagtttcggcaggt

SEQ ID NO: 30871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagaggaggtcttctccgtccactagcatt

SEQ ID NO: 30872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagatctctgtgcgggtagcagaagcggac

SEQ ID NO: 30873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagatgcgacagctggaataaacgaacatt

SEQ ID NO: 30874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagatggtacggtgaaattaggttgaccaa

SEQ ID NO: 30875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagcacggaaactgttcgccgacggttggg

SEQ ID NO: 30876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagcatgctgccgtcgcggggtattgcatg

SEQ ID NO: 30877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagcgaccccttagaagcacatttacctcg

SEQ ID NO: 30878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagcgcggtctagccgactgcttcttcacc

SEQ ID NO: 30879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagcggccgcggtggtgatacgcgtggtat

SEQ ID NO: 30880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagcggcctgtccgagcgtctccgcaggtg

SEQ ID NO: 30881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagcggtcaatcatcccgtaggcctagtct

SEQ ID NO: 30882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagcggtcctggatggcctagactagtggt

SEQ ID NO: 30883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagcggtttacgagtagtgtcggccgcggg

SEQ ID NO: 30884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagctgccggtacaaaactagggggcaagt

SEQ ID NO: 30885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagcttccggttcgcacacgggagggaccg

SEQ ID NO: 30886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaggaccttatccctgcggccggtgcgtca

SEQ ID NO: 30887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaggatttgaaaaacgcgtgcttgacgttc

SEQ ID NO: 30888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaggcatgacatggttgttttcgtgctcgt

SEQ ID NO: 30889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaggccagtcgatcagggattcatgggtcg

SEQ ID NO: 30890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaggcgcataatcgtactcttgcatgtgcg

SEQ ID NO: 30891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaggcggtgacggactcatcatgccagcgg

SEQ ID NO: 30892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaggcttcgggggaggtcgatgctagtagc

SEQ ID NO: 30893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagggactcgcatcaccgactagtggggaa

SEQ ID NO: 30894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagggcgatgttcttccctctggagacacc

SEQ ID NO: 30895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagggctcgcgtaggtagaggtggatcggc

SEQ ID NO: 30896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaggggcgctgagtgatcccctcggttggc

SEQ ID NO: 30897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagggggactccaatgacaggcttatgtct

SEQ ID NO: 30898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagggtctcggcggtcgaaaggcaaacaaa

SEQ ID NO: 30899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagggtgactctgccagtgctactcggcgc

SEQ ID NO: 30900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaggtcatccgttaaagccttcctgttagg

SEQ ID NO: 30901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtaggtcgcggacgtgtttggtactcttggc

SEQ ID NO: 30902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagtaaggatggcggacgtttagcgatagg

SEQ ID NO: 30903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagtaaggttagggtaaccgcgtcggacga

SEQ ID NO: 30904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagtactggttatggaaagcggttctaaac

SEQ ID NO: 30905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagtatagaaccacgggttattcctgtcgc

SEQ ID NO: 30906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagtcaatactagagcgggtacgcgacgag

SEQ ID NO: 30907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagtcacgtcacggaggcgcttcgaacgtg

SEQ ID NO: 30908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagtccgacagtttgcagagtgatgctggg

SEQ ID NO: 30909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagtcgagggaccccttcccaggaagcttg

SEQ ID NO: 30910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagtctggcaggttgctatctgtacgaatc

SEQ ID NO: 30911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagtgcgtgaggtcatcggcttccttacgc

SEQ ID NO: 30912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagtggtcgggctagttttgcttttcgcgc

SEQ ID NO: 30913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagttaggattaccttggtagatcgaagtg

SEQ ID NO: 30914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagttggatcatctcttgatggacgataca

SEQ ID NO: 30915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtagttgtttacgtatcttaaccggcgggct

SEQ ID NO: 30916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatacagtcggatgcagccgaagtgttgcc

SEQ ID NO: 30917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtataccataccattacgtctgattacatac

SEQ ID NO: 30918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatacggacttgacatgctttataaacgag

SEQ ID NO: 30919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatagactagccgcttagtaagcagacccg

SEQ ID NO: 30920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatagtagggcctataccggcatccccacg

SEQ ID NO: 30921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatataatcggcctactggcacctctgagt

SEQ ID NO: 30922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatccagtcagcattctctgcttattcggt

SEQ ID NO: 30923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatcccctcggtggagaactgctggcaatg

SEQ ID NO: 30924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatccggaataggtcttcgggcagtctcgt

SEQ ID NO: 30925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatcgctcccaagggagtcctccgcgtgca

SEQ ID NO: 30926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatcggatgcgcgcggatgccggggaacgc

SEQ ID NO: 30927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatcggctcatagtagggaagtttgtctcg

SEQ ID NO: 30928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatcgttccggtggtgttcatcgccctgac

SEQ ID NO: 30929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatcttgtatctgagtcgggttcacacacc

SEQ ID NO: 30930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgaacatggtttcgggtttcgtctggcg

SEQ ID NO: 30931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgactcccaaaaacttaccgtagtcccc

SEQ ID NO: 30932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgactgtgttatacttgttccacagttg

SEQ ID NO: 30933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgactttatggcggattggattactacg

SEQ ID NO: 30934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgagtctcctcagtataatgctgtcgtt

SEQ ID NO: 30935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgataatgcgatcgaacattgaagccga

SEQ ID NO: 30936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgatccatttgccttagtttttaccggc

SEQ ID NO: 30937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgatggtcggtcaacggaagcgcatcga

SEQ ID NO: 30938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgcagacgtggcaacgtaggggttgtca

SEQ ID NO: 30939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgcggtcaaactgattttggtctatttt

SEQ ID NO: 30940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgcttcgagcataattggaggggcgcga

SEQ ID NO: 30941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatggaccatctccctacgcagtcctgagc

SEQ ID NO: 30942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatggcagaagaagccgatgacccgacggc

SEQ ID NO: 30943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatggcgggcttgaactcgtgctcctgatt

SEQ ID NO: 30944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgggccgcgcgcggatcggtataatgcc

SEQ ID NO: 30945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgggcgccatcaggaacccgttgtgcgt

SEQ ID NO: 30946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgggcgggtgtgctaagcgtgcgtggtt

SEQ ID NO: 30947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatggtcttctgcaacggggactttcactg

SEQ ID NO: 30948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatggttgcgcctcaaccgtgatactgtag

SEQ ID NO: 30949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgtacgagtacaaccacagcgatggtcc

SEQ ID NO: 30950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgtgatcagttttggtggtctgtacctc

SEQ ID NO: 30951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgtgccgcgttaacggaaagcctactac

SEQ ID NO: 30952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgtggtaaaggtaccctatagttgtgga

SEQ ID NO: 30953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgttcatgcggggatctgaagcttcaga

SEQ ID NO: 30954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtatgtttggaacgcgtggtgttgttccgcc

SEQ ID NO: 30955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtattaaatgcgccttgcggacaggcaggat

SEQ ID NO: 30956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtattagaccatggtacgagtaaactgtgaa

SEQ ID NO: 30957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtattaggacaacgtggccggagtgagtagg

SEQ ID NO: 30958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtattcccacagcgatgcgtcgaaactaata

SEQ ID NO: 30959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtattcctaagaacacctgtcgctatagggc

SEQ ID NO: 30960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtattcgtactgaacgaccgaaggccaacta

SEQ ID NO: 30961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtattctagggggcagctccggatggagggg

SEQ ID NO: 30962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtattggttggccagaggtgtaccgcgtatc

SEQ ID NO: 30963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtattgttcgataaggcatattcgggctgtc

SEQ ID NO: 30964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaaaagcatctgaaccgcagtgttggtct

SEQ ID NO: 30965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaaaaggagcacgccccacagacgggcgg

SEQ ID NO: 30966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaacgaaaaggattccgcggcacctctaa

SEQ ID NO: 30967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaacgcgatactttcggctactggaacaa

SEQ ID NO: 30968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaacgggggaatatgggaggcactgggac

SEQ ID NO: 30969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaagctaggtgctaaaagcgggttactgg

SEQ ID NO: 30970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaaggatgaagatgtgtctttctgcagat

SEQ ID NO: 30971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaagtccgtcgtgaatgctctgctacacg

SEQ ID NO: 30972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaagtgtaggtagggatcatgaggtgcgt

SEQ ID NO: 30973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaataagccgttacgttcctataatgtcg

SEQ ID NO: 30974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaatctgacatcgatgagtgcggggacgt

SEQ ID NO: 30975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaatgcccacgccctctatatcgtacgat

SEQ ID NO: 30976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaatgtgttgtccttgagaacgtaaatat

SEQ ID NO: 30977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcacacatcgggcaccgcatacgcttgtac

SEQ ID NO: 30978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcacaggacatgcatcaggatgtcggcgca

SEQ ID NO: 30979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcacatcaagtagagtgttacgtattgttg

SEQ ID NO: 30980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcacattggcacatcttgaaccgctccagt

SEQ ID NO: 30981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcacccaccataggccaacacaaacgtggc

SEQ ID NO: 30982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaccggagaaggacggcagtctgggaccg

SEQ ID NO: 30983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaccggatcggtcgtgataagcctctgtc

SEQ ID NO: 30984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaccgttggttaagggcagacatggccgg

SEQ ID NO: 30985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcacctgttgcgttgtctttgccgagtatc

SEQ ID NO: 30986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaccttaacctggcaccgtagtatgcgcc

SEQ ID NO: 30987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcacgcatttaaactgacgggggatcgtgt

SEQ ID NO: 30988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcacgggtggtgtggttttttgccggggga

SEQ ID NO: 30989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcacggtgatgagaggtgttggtggcggta

SEQ ID NO: 30990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcacgtagtcttcccggaggtaatgcaatt

SEQ ID NO: 30991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcacgtcaagcacagtctctgacgccgatg

SEQ ID NO: 30992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcacgtgggctccagtaaggtttatccttg

SEQ ID NO: 30993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcactaatgatgttatatcagtacaccgag

SEQ ID NO: 30994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcactctgactggtttgcggattcgacggg

SEQ ID NO: 30995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcactgttagttattcaatcacttgatgat

SEQ ID NO: 30996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcagacaagtacactcataccgctaaggta

SEQ ID NO: 30997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcagataagtggtgatgtatgcgtggagcc

SEQ ID NO: 30998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcagatgatggcgacctgttctgtgcgatg

SEQ ID NO: 30999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcagatggaatacggcccccgcggaggagt

SEQ ID NO: 31000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcagattggccgcgaatacatttttctagg

SEQ ID NO: 31001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcagcgggcgagaagttgtagcggttcttg

SEQ ID NO: 31002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcagcgggggaagcatcagagggaccctca

SEQ ID NO: 31003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcagcgtgatggagcaggcgaattttgtgc

SEQ ID NO: 31004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaggaagcttgactgtggcggtcgtagtc

SEQ ID NO: 31005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaggagtgcagtttgaagcgtgttgcgtg

SEQ ID NO: 31006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaggcggagggacctggagatgggtgcgt

SEQ ID NO: 31007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcagggccagtcatgaatggtagccctctg

SEQ ID NO: 31008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcaggtctttacttgccaaatcatcactgt

SEQ ID NO: 31009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcagtagcgcaagtgcctagtatccttctc

SEQ ID NO: 31010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcagtagggtgtaggggcgtatcaggacca

SEQ ID NO: 31011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcagtcggaacacgaattctggcctgcgta

SEQ ID NO: 31012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcagtctttagcttagcgcaattgggtgtg

SEQ ID NO: 31013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcagtggtggttcgcaaagattcgtgcttg

SEQ ID NO: 31014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcagtggttttcattgagccacttctggtt

SEQ ID NO: 31015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcatacagaaacacttagcgtttctacgga

SEQ ID NO: 31016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcatactggagcgatgcctggtagcgttga

SEQ ID NO: 31017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcatagcagcctaacaatgttccgaggcct

SEQ ID NO: 31018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcatatgttgcttcgggattacgcttcgtg

SEQ ID NO: 31019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcatcgatcacccgtggggaggtgtcccgg

SEQ ID NO: 31020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcatgaggcggagatagcatgtagatgtac

SEQ ID NO: 31021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcatgcaacatcttggcgtgtggtggctcg

SEQ ID NO: 31022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcatgcttatgcgttagcagccggacaggt

SEQ ID NO: 31023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcatggcgcaggcagttagtcaggcaacac

SEQ ID NO: 31024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcatgtagggtcgcatatacatcccgacga

SEQ ID NO: 31025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcattaaaacgatgttcttaagagtcgttg

SEQ ID NO: 31026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcattacggtcctatcacaattgcgcgtga

SEQ ID NO: 31027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcattagcaatgtggggtcggggcgtagcg

SEQ ID NO: 31028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcattctcacgtcggaactttaacgggata

SEQ ID NO: 31029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcattggggatatccacaactcccgtcacc

SEQ ID NO: 31030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcatttagactgcatactcggatcttagat

SEQ ID NO: 31031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccaaccacccgctattagtccgtaaggtg

SEQ ID NO: 31032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccaactgtgtacgggagagttgttctcat

SEQ ID NO: 31033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccaagctatccaactaagcattgcacacc

SEQ ID NO: 31034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccaagggagtctcggttttcttaaaacgc

SEQ ID NO: 31035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccaatggtcacgccgcgtttctttaggaa

SEQ ID NO: 31036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccacggcgaatcgatcctgtactgcgtgt

SEQ ID NO: 31037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccacgtgtcatgttgctcgttcatacggt

SEQ ID NO: 31038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccagcggggtgttcctcgacatctgaacg

SEQ ID NO: 31039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccaggcctttgtctgattttcggctgccc

SEQ ID NO: 31040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccaggcttcgtagcatccggctcgctgtg

SEQ ID NO: 31041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccaggttagctagcccccacggcagcgcc

SEQ ID NO: 31042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccatgtcacacgcgtgctagtcttgtgct

SEQ ID NO: 31043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcccacgcgaacattaaaggcacaccgccg

SEQ ID NO: 31044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcccactccatcacacttagagctttcgac

SEQ ID NO: 31045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcccagaaaacgatgcgatcgccagttgca

SEQ ID NO: 31046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcccataagttcgtcaaataggattgagca

SEQ ID NO: 31047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccccacgtgcagggttccataacagaggg

SEQ ID NO: 31048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccccccgaggtcggctccgatgactcagt

SEQ ID NO: 31049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccccctagcctcacacgtgaaacatttcc

SEQ ID NO: 31050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccccgggtgctccgccagcttgacgctag

SEQ ID NO: 31051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcccctgcaatgctcatggtacccggcagt

SEQ ID NO: 31052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcccgcctacttgcattttcgctccgctcg

SEQ ID NO: 31053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcccgcggtgcaaaggttcggcatagttgg

SEQ ID NO: 31054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcccggactgagattagaccccctgatatg

SEQ ID NO: 31055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccctagaaacggaggagatcggtgcctta

SEQ ID NO: 31056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccctcgtcgtcgtagaggcaccgcgttcg

SEQ ID NO: 31057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccctgctcgaaggtgctcacagcaaatga

SEQ ID NO: 31058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccgaactcgtaaatgctggttccgggctg

SEQ ID NO: 31059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccgaaggagtgtatcgtactgaccggttg

SEQ ID NO: 31060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccgattacgctcctggtttgccgctcaga

SEQ ID NO: 31061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccgcacgcgactggtatcacaaccgaagt

SEQ ID NO: 31062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccgcatcgtaagcaggttgcgactgtcac

SEQ ID NO: 31063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccgcgatacccgagcaccaataactgctt

SEQ ID NO: 31064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccgctacttgtgcttccttctactccccg

SEQ ID NO: 31065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccgctcgatccttcgggcgtgtggggtgg

SEQ ID NO: 31066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccgctttccggggcccggtgatagcacgg

SEQ ID NO: 31067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccggaaggtactcgaagttactggggatt

SEQ ID NO: 31068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccggactagttttggggaaaggctccctc

SEQ ID NO: 31069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccggcataccattagacagtggcctttgt

SEQ ID NO: 31070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccggcgtcgcagaaacactgctcttcgtg

SEQ ID NO: 31071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccgggacggcggataatcacacttgagtg

SEQ ID NO: 31072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccgggagaattcacgacaggcaaatttag

SEQ ID NO: 31073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccgggcccgatctggactgctgggttagg

SEQ ID NO: 31074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccggtttcgtcgtggggtgggtcggggtg

SEQ ID NO: 31075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccgttctcctgatcatctacggccgtccg

SEQ ID NO: 31076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcctactagcgtcaaacagtcccagcgtgc

SEQ ID NO: 31077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcctagtctttgcagatcacttcaggactg

SEQ ID NO: 31078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcctgcaacacctgtatcatttggacatat

SEQ ID NO: 31079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcctggcggcaggtatgggtggttagctgt

SEQ ID NO: 31080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcctgggcgcaagcaccaactagaaccttg

SEQ ID NO: 31081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtccttatgtcacaccccacgcccacgttgc

SEQ ID NO: 31082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcctttcgtacgttcgagggtcgtgtgtgg

SEQ ID NO: 31083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcctttgctacgtgcacctaaaaaggcccg

SEQ ID NO: 31084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgaaccgcggggcttagccggtcttgggt

SEQ ID NO: 31085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgaaccttttgtcatagcctcgttcggtc

SEQ ID NO: 31086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgaacgcgttttgagatagtatcccccca

SEQ ID NO: 31087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgaaggtctcagccaacgaggtttaatta

SEQ ID NO: 31088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgaccacctttgatgtcttacggcactct

SEQ ID NO: 31089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgacggctcgcgacacgtaagatttaggg

SEQ ID NO: 31090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgacggtattgcctccttgtcaggacggc

SEQ ID NO: 31091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgacgtgcttgtcctgtcccgcaatggtg

SEQ ID NO: 31092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgacgttgtattcccggactgtacgttgt

SEQ ID NO: 31093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgaggaaacatcggggcaaacgatacttt

SEQ ID NO: 31094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgaggcgccgatttagttgtcctttgggt

SEQ ID NO: 31095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgagtgactccacccgagactgcgtagcg

SEQ ID NO: 31096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgatcttttgcatctggggtacgtgccga

SEQ ID NO: 31097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgcaattgcaacatcactcacaactgcga

SEQ ID NO: 31098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgcacaaacaatcccatagagctgcatca

SEQ ID NO: 31099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgcacgcactcgtctcggtcgaccactcc

SEQ ID NO: 31100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgcccccccggtgacctgctgcggaaggt

SEQ ID NO: 31101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgcgcataacgtgatagtgccctgcgtcg

SEQ ID NO: 31102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgcgccgttaagtggtgaactgggtctcc

SEQ ID NO: 31103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgcgcgccccccgaacggaatgacgagca

SEQ ID NO: 31104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgcgcgttcggtcacgcctaatctgctga

SEQ ID NO: 31105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgcgcttcccccgcccttgctaccgggcc

SEQ ID NO: 31106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgcggcggctagtttccttcggggagtca

SEQ ID NO: 31107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgctcagtctcgtctaggtctggtcctag

SEQ ID NO: 31108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgctctggtggctcaatcagtccttgaca

SEQ ID NO: 31109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgctggggagaacaaatcgtgtcgacttc

SEQ ID NO: 31110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgcttctgactcggtcttggtgcacagca

SEQ ID NO: 31111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcggaacgtttgggtttactggtcctgagt

SEQ ID NO: 31112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcggaatgttgatgagtcgtagttggtgcg

SEQ ID NO: 31113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcggacgaacagcgggctttagttttgttg

SEQ ID NO: 31114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcggacggtcgaccacccttcctgtgcgtt

SEQ ID NO: 31115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcggatcctttccctttttcctgttatcgg

SEQ ID NO: 31116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcggcagccagggcccttctgacgaccaag

SEQ ID NO: 31117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcggcatctggtgtcaggttgtggtggccg

SEQ ID NO: 31118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcggcgtcagacgggctttcaatatctgcg

SEQ ID NO: 31119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcggctgcgggaaagctccgcatagcacga

SEQ ID NO: 31120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgggacgggaattacgcctttcgtcaggg

SEQ ID NO: 31121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgggcccagcacatttcgtaactaacggc

SEQ ID NO: 31122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcggggatgacggctctcatggaatacgct

SEQ ID NO: 31123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgggtgagattgggggctatgatgttctg

SEQ ID NO: 31124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcggtagcgaccaaagaatggctgtggctg

SEQ ID NO: 31125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcggtgctagatggtcgggtagaacgtttg

SEQ ID NO: 31126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcggtggtggattgggatggcgcggttgga

SEQ ID NO: 31127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcggtgtgccgctttaatcttccttgtacg

SEQ ID NO: 31128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgtaggtgtgttccttgacgggcgccaac

SEQ ID NO: 31129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgtagtagctcgtccaggttctgttgatg

SEQ ID NO: 31130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgtcaaggcgaatcgactactcgttgtac

SEQ ID NO: 31131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgtccacccgtgcctgcatggacccctac

SEQ ID NO: 31132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgtgatggctcttggggtcggaaaactta

SEQ ID NO: 31133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgtgcgatcatcaagttgtcacgggtcac

SEQ ID NO: 31134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgtggcgtcttgtatgatgaaacccccgt

SEQ ID NO: 31135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgtgggtgtttggctccgctgtgtgagac

SEQ ID NO: 31136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgtgtcggcatcgcttctatgtgtcgtgc

SEQ ID NO: 31137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgttagattataggcaccgcttggctcat

SEQ ID NO: 31138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcgtttgatagtgctgtagtaaggttgctg

SEQ ID NO: 31139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtctaaggttggttcctgctggagttttaag

SEQ ID NO: 31140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtctaccgaaacgaccaaaggtcaaggtaga

SEQ ID NO: 31141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtctacttctctgaacaccgccagatttgct

SEQ ID NO: 31142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtctcactccgcgcccatagtcaaagcgtcc

SEQ ID NO: 31143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtctccgcgtcttggttgcaaacgagccaat

SEQ ID NO: 31144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtctcgggtataactactgggacttcgcgca

SEQ ID NO: 31145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtctctgtgcgtcgcgttcgagtcccaggct

SEQ ID NO: 31146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtctcttcgtacagatgctcgtaggtcctgt

SEQ ID NO: 31147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtctgcaaactttagcgctactatagacccg

SEQ ID NO: 31148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtctgcattttcgaacctcgacccttctacg

SEQ ID NO: 31149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtctgcgttcgacgatgtgtttcagcgtggt

SEQ ID NO: 31150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtctgggcacttttcctgaataaacacgagc

SEQ ID NO: 31151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtctggttcgatctctactgtgcattaggtc

SEQ ID NO: 31152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtctgtatggccacctaccagcgagtccttg

SEQ ID NO: 31153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtctgtgagtagggtgtgaaatccccgttct

SEQ ID NO: 31154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcttacaactttcgaggcgtggcgacccca

SEQ ID NO: 31155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcttagctgagcagttccgtagataggagt

SEQ ID NO: 31156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcttccgaatcaacatttaattatccgccg

SEQ ID NO: 31157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcttgaacgggactcctgacctgttatgaa

SEQ ID NO: 31158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcttggcaggatgtcacgcccggatagttg

SEQ ID NO: 31159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcttgggcgaggtttagtcatggcgccttc

SEQ ID NO: 31160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtcttggtctcatgttcagtaatatgaacga

SEQ ID NO: 31161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtctttgtatgacttgggggcgcggttttgc

SEQ ID NO: 31162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaaacagtcgttagggagacgtcaagacc

SEQ ID NO: 31163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaacatatcgatcagaagccccgcgtctt

SEQ ID NO: 31164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaaccggagcaacgacattctcgtgttcg

SEQ ID NO: 31165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaacctgttagtcacccgtaacgtgcctg

SEQ ID NO: 31166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaacgaattgcctcgcggattcgtgctct

SEQ ID NO: 31167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaacgaggagcactgatcgcggcaagtag

SEQ ID NO: 31168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaacgcagtatcaatgaggagagtgtccc

SEQ ID NO: 31169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaacggatcctacttttaagagaccgggt

SEQ ID NO: 31170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaagagcaatctcatggattcgtctcgtg

SEQ ID NO: 31171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaaggctttcgatcacaatcgagtttgtg

SEQ ID NO: 31172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaagggcagggtacaccctttttggactt

SEQ ID NO: 31173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaagggcaggttgtagttgccaggcgtgc

SEQ ID NO: 31174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaagggtgtggcattggagctaggttatg

SEQ ID NO: 31175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaagtagttgactggtgatagctatcctt

SEQ ID NO: 31176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaataggccagggaaaaagtcggtgcgta

SEQ ID NO: 31177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaatcacggcaaataagatgattgaatgg

SEQ ID NO: 31178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaattgttgtgtttgtcgcctgggggttc

SEQ ID NO: 31179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgacaaacgttttagggttagtgtcatttg

SEQ ID NO: 31180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgacaaaggcctgtgagggtttgcaacgac

SEQ ID NO: 31181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgacacagtgtctgtgtttcattctggtac

SEQ ID NO: 31182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgacagaagcttctcgttagggaagaccat

SEQ ID NO: 31183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgacagtaactcggaacgaccacgcgcagg

SEQ ID NO: 31184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgacatggcagtcagcggttatcgagggat

SEQ ID NO: 31185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaccagggggaactacgatgtagctcggt

SEQ ID NO: 31186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgacccgatgcagtcaaatcttagcacgtg

SEQ ID NO: 31187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaccctgggcctttgacgggtgctaatag

SEQ ID NO: 31188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaccgaagtggcccgggacgactgccgga

SEQ ID NO: 31189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaccgggagacccgacggttttgtttttg

SEQ ID NO: 31190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgacgagatgcgccacctcgccgtttgtca

SEQ ID NO: 31191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgacgggcgctattgaataattattgggtg

SEQ ID NO: 31192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgacgtgcgtgggtcgtcaagcggcgggtg

SEQ ID NO: 31193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgacgttaccggtgaacaagaccaaaggcg

SEQ ID NO: 31194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgactcggcgacagtacctccctcgactcc

SEQ ID NO: 31195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgactgaatcgtgcaaaattctccagccac

SEQ ID NO: 31196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgactgcatctactctggtgtggcttaaac

SEQ ID NO: 31197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgactgtacgttgaatgtcgggtaagcgtt

SEQ ID NO: 31198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgacttccagcccgctgctcaggggttaat

SEQ ID NO: 31199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgagaccgcgctatgctggcacaggcagaa

SEQ ID NO: 31200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgagatggaatcccatcgcaatggcctttc

SEQ ID NO: 31201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgagcggttttgtcacgattcgttggcctg

SEQ ID NO: 31202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgagcgttgtgagctctcacgtgcgggata

SEQ ID NO: 31203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgagctgaggcctgcagattaacggcacat

SEQ ID NO: 31204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgagcttacgtttgtggctcttcaggggcg

SEQ ID NO: 31205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaggacgaatggccgagatattcctggat

SEQ ID NO: 31206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaggacgtagaaaggcaggcatagtgtgc

SEQ ID NO: 31207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaggactcatcggcatgaccgggcaatac

SEQ ID NO: 31208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaggccgctcgccgttctggccggtgccc

SEQ ID NO: 31209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaggccggtcttttctcgttgcggttagt

SEQ ID NO: 31210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaggcctaaggtgacgttctattcgacat

SEQ ID NO: 31211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgagggccggtgctgggtgagctgctcgtc

SEQ ID NO: 31212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgaggtgccgccgatacgcggtcctgcgtg

SEQ ID NO: 31213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgagtaccgggacactgcacgctatgatat

SEQ ID NO: 31214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgagtgtatgtgaaggggccggaacccact

SEQ ID NO: 31215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatacgtaatacgatcgagcacgatgggt

SEQ ID NO: 31216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatactggctatggatgcggcgcggattt

SEQ ID NO: 31217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatagctacatgcaaggcccatagtacct

SEQ ID NO: 31218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgataggcctatgcttggtatttgaagtgg

SEQ ID NO: 31219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatagtttatgtcagtagaggctgtagtg

SEQ ID NO: 31220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatatagaatcccgtcatggagcaggatt

SEQ ID NO: 31221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatatgcatagcccacagagttgtatccc

SEQ ID NO: 31222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatcagataggcatatttcaaatactggc

SEQ ID NO: 31223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatcaggacattccacagtgttgggcgcg

SEQ ID NO: 31224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatcaggccaaaacacagacatactggtg

SEQ ID NO: 31225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatgacaattttcggaaggtgcaataggc

SEQ ID NO: 31226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatgacatggtcagtttttattaatcctg

SEQ ID NO: 31227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatgatagggaggctgattgtattgaact

SEQ ID NO: 31228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatgggactgaatcccctgcctgagtatc

SEQ ID NO: 31229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatgtactccttgtcagtgggctcggtgt

SEQ ID NO: 31230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatgtatgagttaggctttgcgcaggacc

SEQ ID NO: 31231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatgtccggttcgtagtaacgagtgttgt

SEQ ID NO: 31232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatgtgcgactgctccagctgtagttctc

SEQ ID NO: 31233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatgtgtgagttagccgctcagcaagtat

SEQ ID NO: 31234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgattgccatcgtatggagatttccagagc

SEQ ID NO: 31235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgattggaatgcaaaaaaggaggatgctgg

SEQ ID NO: 31236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgatttggcgccaacgcaatgtggaacact

SEQ ID NO: 31237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcaaaaatcttatgtctggtctcgagggt

SEQ ID NO: 31238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcaacggtaccgatatcgtattcattgca

SEQ ID NO: 31239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcaagcatcgtgtgtggtcgcagtgaagt

SEQ ID NO: 31240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcaaggataacggtgtctctctccctcat

SEQ ID NO: 31241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcaagtcgttgggttcgctattcgtgccg

SEQ ID NO: 31242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcaatcgggcaatatcttgaattccggtt

SEQ ID NO: 31243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcaattccatcgggcccgaggatgcattc

SEQ ID NO: 31244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcacataattccgggccggatgcttaagg

SEQ ID NO: 31245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcaccattcggagtaggagcggctgacgg

SEQ ID NO: 31246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcacgggcgcattgagctttgggattcct

SEQ ID NO: 31247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcactaaaaagttattgttcttgaatacg

SEQ ID NO: 31248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcagcccttaacgtgtcctcaggtgggtg

SEQ ID NO: 31249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcagctcccgaacatccaaacgtgcaagc

SEQ ID NO: 31250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcagctgaaaaacccttattaagctctga

SEQ ID NO: 31251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcagctggctttcccgaagttcagtcgtc

SEQ ID NO: 31252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcaggtaaactaatcaacggggtaacaag

SEQ ID NO: 31253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcaggttgagtccaaggctaccttaacca

SEQ ID NO: 31254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcagttaagactacgtacagtcagctagt

SEQ ID NO: 31255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcagttgttacatagggctgcacagcacg

SEQ ID NO: 31256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcagttttcgtatccatattggctgtgta

SEQ ID NO: 31257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcatatcgtgccatcttaaggctgggttg

SEQ ID NO: 31258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcatgtagcaatgaccgcgatgcctcatt

SEQ ID NO: 31259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgccaaaccgtagggatgcaacgagtcatc

SEQ ID NO: 31260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgccaacaacgtgtagttatgcttggcccc

SEQ ID NO: 31261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgccacacctgcctgtttcgccgctcggat

SEQ ID NO: 31262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgccaccagaccgtctagtcagtcagctcg

SEQ ID NO: 31263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgccactgtaccaggcgtaggcaagcactg

SEQ ID NO: 31264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgccagatacgaacggtccacgggttatgg

SEQ ID NO: 31265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgccagttttttcagtgtccggcatgggat

SEQ ID NO: 31266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcccgacgtcccgcgaaatcttgctggtg

SEQ ID NO: 31267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcccggattagggacgtaggcgcgttggg

SEQ ID NO: 31268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcccgggatctcgtgccgtgaagaaggtt

SEQ ID NO: 31269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgccgaaagccggagaagtaggcgaagtcg

SEQ ID NO: 31270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgccgaccagcgcgaggaatctttgtgtcc

SEQ ID NO: 31271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgccgacgcatcccggacgtcagtgtccgt

SEQ ID NO: 31272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgccgattgaaggggcgtgctagcaggtgc

SEQ ID NO: 31273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgccgcaaaattaggggggtgggggtagag

SEQ ID NO: 31274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgccggaagttttttggtttgcgtgaaata

SEQ ID NO: 31275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgccgggcttgttggggaagcgtttataaa

SEQ ID NO: 31276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgccgtagtggggctgaacagattgcttag

SEQ ID NO: 31277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgccgtatggggtgtcatactcacccgcga

SEQ ID NO: 31278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcctgcgtgctgtgaacaggggatagggc

SEQ ID NO: 31279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgccttgggtagaatattttctatctattc

SEQ ID NO: 31280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcctttcctgggtcacaagattgttgcca

SEQ ID NO: 31281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgaccttctatctgatgatgctggtaca

SEQ ID NO: 31282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgagtggccctgttagaaggcaatcgat

SEQ ID NO: 31283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgatgctactggtaggatggggggtgca

SEQ ID NO: 31284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgcgaagtgggggcaagggatgcgcgtt

SEQ ID NO: 31285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgcgccccatctcggtacctctgatctc

SEQ ID NO: 31286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgcgtctcttccaagggccattgacgag

SEQ ID NO: 31287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcggaacgtctaacgaatcagttgtttgg

SEQ ID NO: 31288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcggataggcaggtatgacaccccttggc

SEQ ID NO: 31289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcggatgtctgtgactcagttcttggtgg

SEQ ID NO: 31290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcggcacggtgaaatgagatcaccattcg

SEQ ID NO: 31291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcggcgacgctgatcaacttgcagcgggt

SEQ ID NO: 31292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcggctcatgctaagtgcgtgggatcatc

SEQ ID NO: 31293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcggctttggcttttgagggtgctatcct

SEQ ID NO: 31294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgggctcttgtctaggaaattcaagcac

SEQ ID NO: 31295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgggtcagcagctcgagtcaggcccgtg

SEQ ID NO: 31296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgtacggtgtgtttaaccagaaacggtt

SEQ ID NO: 31297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgtacttgttcatggaaactatggtgac

SEQ ID NO: 31298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgtatgcggtcgctggagatccttaggg

SEQ ID NO: 31299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgtccagctaatgggatgactcggcgtt

SEQ ID NO: 31300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgtctcagtcagaataaaaacccggtga

SEQ ID NO: 31301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgtgatatctagtcacacagggatgccg

SEQ ID NO: 31302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgtgcaactctgacgcggatccggacac

SEQ ID NO: 31303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgtgccattagcgcatgatatccgcaag

SEQ ID NO: 31304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgtgctcgacattacgcttctcggggtg

SEQ ID NO: 31305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgtgggttcgtccttcagcccgaccttg

SEQ ID NO: 31306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgtgtgccccttcgaacatttggcgagg

SEQ ID NO: 31307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgttaagaaactgagcggtacaggatgg

SEQ ID NO: 31308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgttacagcccgatattttcatttttca

SEQ ID NO: 31309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcgtttgcgctccgtgacgcatttattgg

SEQ ID NO: 31310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctactttcacacggctcccaagggtcac

SEQ ID NO: 31311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctagatgcgcgggcttagtccggaggaa

SEQ ID NO: 31312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctagcgaagttttctgtcgggctcctgt

SEQ ID NO: 31313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctagtacgccttaatcctaaacggttga

SEQ ID NO: 31314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctcactcacaagttgggcctacttcccc

SEQ ID NO: 31315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctcagggggatgtctcaaaataggatgc

SEQ ID NO: 31316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctcagtccctaacccgacgcaagcaaga

SEQ ID NO: 31317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctctagcgtgataacgatgtcctgaagc

SEQ ID NO: 31318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctgaaaatagggggtacaaccagtagcc

SEQ ID NO: 31319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctgcaacaacactggtacgagggtgcgc

SEQ ID NO: 31320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctgcagcgcttcacttttagcgggcatc

SEQ ID NO: 31321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctgcgggatccggggagacggtggggca

SEQ ID NO: 31322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctgcggtagtgcgcatggtcgaatgccg

SEQ ID NO: 31323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctgcgtttagtgactcacagataccttg

SEQ ID NO: 31324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctggccctgaagcctttatgatggcagg

SEQ ID NO: 31325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctgggggtctatgtttgacggggttggc

SEQ ID NO: 31326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctgggtcggaggcgcacttaggatggcc

SEQ ID NO: 31327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctgttttgaccagagtatttagtaattt

SEQ ID NO: 31328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcttccatcattctggatcgtcccgtcgc

SEQ ID NO: 31329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcttccctgtgttgtggctcccacgtcgt

SEQ ID NO: 31330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgcttggaccccaatcggcttggtattatg

SEQ ID NO: 31331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgctttgccacacttgattttggtcggtcg

SEQ ID NO: 31332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggaaaaactttcatacttatcaaccgatg

SEQ ID NO: 31333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggaaacacatgcgggcgtatggtggatgc

SEQ ID NO: 31334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggaaagctttgtaacggcactgcctcgta

SEQ ID NO: 31335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggaaattagcctctacaggggtttttcgg

SEQ ID NO: 31336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggaacaagcttttgctgttcgtgcgcgga

SEQ ID NO: 31337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggaacggtaacttcgatacgtcaatgccg

SEQ ID NO: 31338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggaagggaatgccggggaatttagccgag

SEQ ID NO: 31339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggaagttggagaggagcctaacctggggg

SEQ ID NO: 31340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggacacgaacatgcaatgggcggtggggg

SEQ ID NO: 31341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggacatttatgaggatatatgaggaatta

SEQ ID NO: 31342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggaccgttaatctgtttatcagacgtcct

SEQ ID NO: 31343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggactaggactgcgtgtctaccgtgccct

SEQ ID NO: 31344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggactcactctagccctcgtctctgttgc

SEQ ID NO: 31345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggagacttggcctcgggcgaggggcagac

SEQ ID NO: 31346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggagatctctttctttgggcggtcactgt

SEQ ID NO: 31347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggagccgtatcctgaaggtgctagagcac

SEQ ID NO: 31348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggagcctggtctactgcagctagtttccg

SEQ ID NO: 31349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggagcgcgtgtatgtatagagtcactcct

SEQ ID NO: 31350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggagcggactggcttaggcgctactctca

SEQ ID NO: 31351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggagcggcctattcgtgggggggcttctc

SEQ ID NO: 31352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggagcggtcgggcggactattgttcggga

SEQ ID NO: 31353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggaggaattgtacaagttcgtgaccgtgg

SEQ ID NO: 31354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggaggcggtagttggttctcggttactcc

SEQ ID NO: 31355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggaggtacgcctcaggtactgaacggagc

SEQ ID NO: 31356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggagtcagcggggaggagatagatgaggg

SEQ ID NO: 31357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggagtcttgattttggatacggtgtgagt

SEQ ID NO: 31358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggatacacaaagctccggggaactcacac

SEQ ID NO: 31359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggatacgttctcgcaagcttgcatcatgc

SEQ ID NO: 31360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggataggttatgggaatttagcgggtctg

SEQ ID NO: 31361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggatagtggtagtctggctagtgtagtct

SEQ ID NO: 31362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggatcgtgtcactctgttgtaggaccatt

SEQ ID NO: 31363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggatctctcccttcctaccgtattatgaa

SEQ ID NO: 31364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggatggcagggggacacttggtagcgttc

SEQ ID NO: 31365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggattacgggggagtatccgatcgcgctt

SEQ ID NO: 31366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggatttcgggggaaaagggtggacgtaat

SEQ ID NO: 31367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggatttgacgggggtctggcagagtcggg

SEQ ID NO: 31368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcaacccgtcgtgcaggtggcgctcacg

SEQ ID NO: 31369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcaacgattgggaacgtatcttagggtt

SEQ ID NO: 31370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcaatttcaggatcacgacgctaggtca

SEQ ID NO: 31371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcactggggaccaaagtagtccagcacg

SEQ ID NO: 31372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcagtacgtgggaggtccatcggggcac

SEQ ID NO: 31373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcagttgcgtttgccattccagtggctc

SEQ ID NO: 31374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcatcggacacatacaacgataggcgat

SEQ ID NO: 31375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggccaccttttagtgtcactaagcattga

SEQ ID NO: 31376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggccagttgcgctccatgattcaatcggg

SEQ ID NO: 31377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggccattattttgtatcctcaatctgtat

SEQ ID NO: 31378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcccttcatctgacccccaggcagcgaa

SEQ ID NO: 31379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggccgacacagcatgtttatgtgctggta

SEQ ID NO: 31380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggccggggacaagggcagttcgcgtttgt

SEQ ID NO: 31381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcctttaaactgagagccgcccctgggt

SEQ ID NO: 31382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcgaacttcattgtgtttctaccttccg

SEQ ID NO: 31383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcgactgttgctggctagggtagcggag

SEQ ID NO: 31384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcgcagtggtttgggaacgccgatggcc

SEQ ID NO: 31385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcgcgaaatcgccaagtccgagtgcctg

SEQ ID NO: 31386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcggaaggtcggacactgtttggtcgtc

SEQ ID NO: 31387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcgtaactatatgatttgttatctcttg

SEQ ID NO: 31388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcgtacatggtgacgttttgtggggctc

SEQ ID NO: 31389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcgtctgaatcgaatgggttatgggttt

SEQ ID NO: 31390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcgttcctttctggactacctctgctgg

SEQ ID NO: 31391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggctcagttcggtaaaaggcccgcttatc

SEQ ID NO: 31392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggctccaaaggcggtacagttggctaggg

SEQ ID NO: 31393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggctgacaatcacactagacttgcgatct

SEQ ID NO: 31394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggctgatttctctggcacgcacgactcgg

SEQ ID NO: 31395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggctgccgtgacatgcggcacaatgggac

SEQ ID NO: 31396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggctgggggtttggcctgatgccgcagat

SEQ ID NO: 31397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggcttgtagcgtttaaagaggtgcacaaa

SEQ ID NO: 31398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggaacctgacgcacatcccccatccacg

SEQ ID NO: 31399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggacagaaacattcaacaggtacggctc

SEQ ID NO: 31400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggaccggcctctctcttcctgagtacgg

SEQ ID NO: 31401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggagcaatcacgtatccttgctacagtg

SEQ ID NO: 31402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggaggcttacacggtcgggatttgtacc

SEQ ID NO: 31403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggagggagccagtccttagggctacata

SEQ ID NO: 31404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggagtgcaagtgtcattggaattcattg

SEQ ID NO: 31405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggatcttccgagatgggttgaccagggg

SEQ ID NO: 31406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggcacaccataagcactgtttcccaacg

SEQ ID NO: 31407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggcacgaccttcacacaaagcgggtttc

SEQ ID NO: 31408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggcagattccgatttgaagcggcgcgac

SEQ ID NO: 31409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggccgttgtcttgggccccataacggaa

SEQ ID NO: 31410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggcgacaacgaggttacgcgccccagtg

SEQ ID NO: 31411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggcgggccaatgcacattatgattgacc

SEQ ID NO: 31412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggctaggcggcagcacgtgggtaatatc

SEQ ID NO: 31413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggctcggagggcaggaggtgcgttctcg

SEQ ID NO: 31414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggctgtacttcggaagaggccttgttcg

SEQ ID NO: 31415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggcttaattaggggctagctgtttatta

SEQ ID NO: 31416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggggaggagcatcgcgtgttgggcagata

SEQ ID NO: 31417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggggcaactgcgtgacatattgttgggca

SEQ ID NO: 31418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggggcgcagattaccgaggcgtgccatct

SEQ ID NO: 31419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggggctttcaacacctataggtcatgtca

SEQ ID NO: 31420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggggagaggttcgttcgacgaccggctg

SEQ ID NO: 31421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggggggagaccgggttaaaaggcggaact

SEQ ID NO: 31422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggggtctgattagagcggcatctgatgt

SEQ ID NO: 31423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggtaagatacgtgaggaatcatcgctat

SEQ ID NO: 31424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggtacaagtagcaagacgagacgtgtcc

SEQ ID NO: 31425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggtcaaatggggagacgaaaaggtggag

SEQ ID NO: 31426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggtccctacgcgctaccggaaaagtcgg

SEQ ID NO: 31427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggtcggactataaacgagcggttaactc

SEQ ID NO: 31428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggtgaccacaacgtattgtgccaccgct

SEQ ID NO: 31429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgggttgactttggacgctgcccttcggtc

SEQ ID NO: 31430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtaactgaaatgcgacaagatgtgatgg

SEQ ID NO: 31431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtaagttttagctggagatcattttttg

SEQ ID NO: 31432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtacatgtcggcgagtagtatgtcaaga

SEQ ID NO: 31433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtaccactacatgcgcggaccgctctgc

SEQ ID NO: 31434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtacggtaacatgattgacttcgaatta

SEQ ID NO: 31435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtagcgaatgtgtgaattgtggtcgatc

SEQ ID NO: 31436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtatcaccgaacacactccaaggcagtt

SEQ ID NO: 31437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtatcgcgctcagcaatttcacggcctc

SEQ ID NO: 31438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtatgcgcgaagtaaatggtggcatctc

SEQ ID NO: 31439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtcaaaagagcgtttcacagatggtcta

SEQ ID NO: 31440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtcaaagtgtggtaaggtcggtttctgc

SEQ ID NO: 31441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtcaagttaaagccgtacgaagtgactt

SEQ ID NO: 31442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtcacactcggtcggcaagtaggtgtag

SEQ ID NO: 31443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtcatgttcatagcgttatcccgggtaa

SEQ ID NO: 31444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtcgggcgttagcatcttgtatgtgttc

SEQ ID NO: 31445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtgacacgagctagacgaacggatggga

SEQ ID NO: 31446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtgagcagtgtggtattgaagagacacg

SEQ ID NO: 31447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtgcagctgttcagacgtccagatgcgc

SEQ ID NO: 31448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtgccgtcagttgatcgtgggcggcgca

SEQ ID NO: 31449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtgcttctattgaccttctggggcggag

SEQ ID NO: 31450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtgggcacgatgacaaactctggagtga

SEQ ID NO: 31451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtgtcgtctccgatactgcgttgaccaa

SEQ ID NO: 31452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtgttgactgtgggctaccggaacgcta

SEQ ID NO: 31453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggttcaccaatctcgcaaatcatgcaaca

SEQ ID NO: 31454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggttcagcacttatagcaatgtttgcgac

SEQ ID NO: 31455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggttcgtgattttattatctcgttgtttg

SEQ ID NO: 31456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggttcgttatagcctgtcggaaactatcg

SEQ ID NO: 31457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggttggaggacgtgtctaggttctcgtgt

SEQ ID NO: 31458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggttggattgcgcttgtagacggcgatga

SEQ ID NO: 31459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggttgtgaggcgtcctcgttaggtcatgt

SEQ ID NO: 31460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtttagttttccgctgatccaccggctt

SEQ ID NO: 31461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtggtttgaagaaggggttggggtggagtgc

SEQ ID NO: 31462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtaaccccggcgaggtgggagttccgcca

SEQ ID NO: 31463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtaacggttcaatagtggtcacccagcca

SEQ ID NO: 31464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtaccgtagcgttggcgctgttcgcctgt

SEQ ID NO: 31465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtacgcgagcctctccggggtacacttca

SEQ ID NO: 31466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtacggcaaatgtgcctgaggtcgatgac

SEQ ID NO: 31467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtacgtcagtactgtttagtactcaacat

SEQ ID NO: 31468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtactccggaactagcaggttttcatggt

SEQ ID NO: 31469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtactgggtcgctgtatcgttagtggtac

SEQ ID NO: 31470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtagccaccgcatgctccgtgttatgttg

SEQ ID NO: 31471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtagcggagcatcatgtgcctcatttttc

SEQ ID NO: 31472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtagggatataggcttgccggtgttgtgt

SEQ ID NO: 31473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtagttgtcggttacctgcatgagattgt

SEQ ID NO: 31474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtatacgccttaagggtcagtttcttgcg

SEQ ID NO: 31475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtcacgtggttttgagaacccacccctgc

SEQ ID NO: 31476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtcagataccgtatcgtgactggactgat

SEQ ID NO: 31477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtcagcatgtgcgtgggtcctcatcttat

SEQ ID NO: 31478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtcaggccccgcgataattatttcctccg

SEQ ID NO: 31479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtcagggtcttcacgaggggggcctcggt

SEQ ID NO: 31480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtcaggtacggaccggttgcgcacgtagc

SEQ ID NO: 31481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtcaggtttagtggtcggaggtggggccg

SEQ ID NO: 31482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtcatccaaaggttgcgtggaacccttgc

SEQ ID NO: 31483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtcatctggcatttgacccataaggccct

SEQ ID NO: 31484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtcatttgcacatacaaatacggtggtga

SEQ ID NO: 31485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtccaccagacgtacatcccgcttgtacg

SEQ ID NO: 31486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtcccgatctcgctaattttattcagctc

SEQ ID NO: 31487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtccttgatattcaagctggtggcctcta

SEQ ID NO: 31488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtcgctctttccacctgcctcttacgggc

SEQ ID NO: 31489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtcggtaccctgactggtttgctgacctt

SEQ ID NO: 31490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtctgacacagtttaccagggttgggtgt

SEQ ID NO: 31491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtcttttcttcaatagatgtcgtattcct

SEQ ID NO: 31492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtgaagccagggagctaacggtacgagca

SEQ ID NO: 31493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtgaccgccgctacgctcttttggagctt

SEQ ID NO: 31494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtgcaccacttgctacgggggcccgtctg

SEQ ID NO: 31495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtgcagccttctcgggtaaactttttctc

SEQ ID NO: 31496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtgccccctaagcagtgatcggggtacgc

SEQ ID NO: 31497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtgcggtacccagctcggaacacggcggg

SEQ ID NO: 31498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtgctgcggactagcgcctacttcaatcg

SEQ ID NO: 31499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtgggtccaaaccccggtgactgtcctca

SEQ ID NO: 31500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtggtcatggggtttcgcgcctcgttata

SEQ ID NO: 31501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtggtctcgagtagagttaggtgtcgtag

SEQ ID NO: 31502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtggtgctgcctgtgttgctttgcatcgc

SEQ ID NO: 31503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtggtggaacgtcggagagtttcctcgag

SEQ ID NO: 31504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtggtgtagccgattttattacgggtgat

SEQ ID NO: 31505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtgtcctaacgtgcttcctgcgtatttgc

SEQ ID NO: 31506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtgtgatcaatgattgggctagtatttat

SEQ ID NO: 31507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtgtggacacatgacggggatggcttgta

SEQ ID NO: 31508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtgttggatctaccggccaatgcgagacg

SEQ ID NO: 31509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtgtttctgctctagtgtggtggggctgt

SEQ ID NO: 31510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgttaaggggacctggtcgcctcttcgtcg

SEQ ID NO: 31511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgttacaagatttctcctgtagtaatccgg

SEQ ID NO: 31512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgttatagaccgggattcgggtcctatacg

SEQ ID NO: 31513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgttccaaaatcggttgtggccgcagtagg

SEQ ID NO: 31514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgttccacaattgtgtggaccggggttgga

SEQ ID NO: 31515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgttccgacaattgggtttgcggtatggga

SEQ ID NO: 31516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgttcggagtggtctgcagtctttgtcgcg

SEQ ID NO: 31517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgttcgggtaaagggaatggtaggatatct

SEQ ID NO: 31518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgttcgttttctgaacgttccccagttcac

SEQ ID NO: 31519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgttgaagcagtcgtggcgagcagagtttc

SEQ ID NO: 31520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtttatacagcatcgagaagtgacaggct

SEQ ID NO: 31521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtttggatgtgcgagaattgtcccacgtt

SEQ ID NO: 31522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtgtttttctaaagcttcgtaacacaggtgc

SEQ ID NO: 31523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttaaaagcccaccaggcgagagtctacacg

SEQ ID NO: 31524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttaaacacaatctctggtcgttgccttctc

SEQ ID NO: 31525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttaaattcattgcgtaatatggaggtttgt

SEQ ID NO: 31526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttaaccacgaccgcggcagtacttgggtgc

SEQ ID NO: 31527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttaatcgcggtacaaatgtagatcgagtgt

SEQ ID NO: 31528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttaattactgaagatagacgctagactgct

SEQ ID NO: 31529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttacaagacgggcttacggcctcttagctc

SEQ ID NO: 31530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttacaccgatgaagggacgcgctgcagcca

SEQ ID NO: 31531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttacagacagttagttttacagtatcgatc

SEQ ID NO: 31532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttacatgttattgaatggggtggttactgt

SEQ ID NO: 31533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttacccactgctagggagacatgctgctgc

SEQ ID NO: 31534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttaccccgggactgtcatcattttaacctt

SEQ ID NO: 31535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttacgatcagtgtgatagagggttttcccc

SEQ ID NO: 31536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttacgcgggaagctatggtcctcgtgtcgt

SEQ ID NO: 31537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttacggctcggtagtgattatgcggaaggt

SEQ ID NO: 31538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttacggtgttatgctttttacgtagtagtt

SEQ ID NO: 31539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttacgtggtgcaatgtgggacggaatgttg

SEQ ID NO: 31540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttacgttaagtgcttccggtaccacgtcat

SEQ ID NO: 31541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttacgttcacgcctccttcggtagccgtct

SEQ ID NO: 31542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttactcaaaagagcgtccgacacacaaact

SEQ ID NO: 31543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttagcaactgagggaggcggccggtagttt

SEQ ID NO: 31544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttagcacgttaggctccgttacatagttgg

SEQ ID NO: 31545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttagcgtatccggattgtcaggcaatgggg

SEQ ID NO: 31546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttagctcacaaatgatggtccttcgttcac

SEQ ID NO: 31547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttaggcaagcttaccttaccgctcccgggg

SEQ ID NO: 31548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttaggcactatcgatgagaaccataccatc

SEQ ID NO: 31549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttaggtaatttccacttaatctgtgtcctt

SEQ ID NO: 31550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttaggtttggtgaggcgcttgttgtcgcgt

SEQ ID NO: 31551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttagtggcactggggggacatggattgctc

SEQ ID NO: 31552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttataataaatgcgggaccgatttgtggac

SEQ ID NO: 31553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttatccacactggcgattttcacggtctgc

SEQ ID NO: 31554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttatccatgtgggcattccggtagtaggtg

SEQ ID NO: 31555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttatcgtcagaggcgagctggtctccatag

SEQ ID NO: 31556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttatctccccgcatgttaagggagcggatg

SEQ ID NO: 31557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttatctgtttctgtatcagacgcggggctg

SEQ ID NO: 31558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttatgagcgacggatctaaacgcgtctcgt

SEQ ID NO: 31559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttatggtagtgtagtggtcggttcaagggc

SEQ ID NO: 31560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttatggtgggcctccttgactgccccgttc

SEQ ID NO: 31561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttatgtgggtggcgtatattgagtcttcgg

SEQ ID NO: 31562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttatgttacgtggactcagacgttcagtaa

SEQ ID NO: 31563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttattagcatgaagcacttatttagaatcg

SEQ ID NO: 31564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcaaatcactaggtgttacggtgtacgta

SEQ ID NO: 31565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcaaccggtgatgttcgactagcgtccta

SEQ ID NO: 31566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcaaggacggctctgggtccgatcactca

SEQ ID NO: 31567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcaagttcgggtcttcacgagagtgttct

SEQ ID NO: 31568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcaatcccattgagtcaaatttcggcgtt

SEQ ID NO: 31569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcaatgctctagagcgttttatgtatgtt

SEQ ID NO: 31570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcaattagtcttgacaatatgcaaacgtg

SEQ ID NO: 31571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcaccgtacctatgttatctactgtaacg

SEQ ID NO: 31572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcacctattgttaaagattttattgaaac

SEQ ID NO: 31573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcacgcgtttaccagatcacgagttcact

SEQ ID NO: 31574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcactaaccaaaaatagaatcttgaggcg

SEQ ID NO: 31575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcactaagtcctagcagatggcagctttg

SEQ ID NO: 31576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcactaataagcacacagtctgacgccct

SEQ ID NO: 31577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcagacgtatcactaagaccgcccgtaca

SEQ ID NO: 31578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcagttggtcgttcagggtacaagcggta

SEQ ID NO: 31579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcatatgtcggccagtgattgcttaggct

SEQ ID NO: 31580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcatgatgaaccgacatcagatgcaatcg

SEQ ID NO: 31581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcatgccaatattccagttgtggatgtgg

SEQ ID NO: 31582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttccaactaaagtgcttaaggagttaggag

SEQ ID NO: 31583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttccacgaaaggtcatggatattgattcgg

SEQ ID NO: 31584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttccattaacaaagactagatgttgatttg

SEQ ID NO: 31585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttccccgcgtcgggctttcggtcaccgccg

SEQ ID NO: 31586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttccccggcgttccgctggtcggcagcgtc

SEQ ID NO: 31587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttccccgtaaatgtgccagcgccactctgg

SEQ ID NO: 31588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcccgcgttatgcgcgctctgttggcatt

SEQ ID NO: 31589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttccgaaccccgatgctctccgcggtctac

SEQ ID NO: 31590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttccgactttgagctagtgaggtagcccta

SEQ ID NO: 31591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttccgagcatctgctgtccgtagaacttcc

SEQ ID NO: 31592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttccgcagacgatcagtgattaaacgttag

SEQ ID NO: 31593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttccggtactcacaggcttagtttgccctg

SEQ ID NO: 31594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttccggtcggggtaacatcctgcggtccgt

SEQ ID NO: 31595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttccgttgaggtgggttgagtcttagtggc

SEQ ID NO: 31596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcctagggcttttgagcgcgcttattgtc

SEQ ID NO: 31597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcctatgcctcgtttcgcgcgtgggtatg

SEQ ID NO: 31598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcctgcagttgtatgtgtgtcacgcttcg

SEQ ID NO: 31599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttccttaaaactgcgtgccacgaaccatgt

SEQ ID NO: 31600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcgactgcgacgttggatccagtcgacgc

SEQ ID NO: 31601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcgagacggtaaaatgagggttcccgcgt

SEQ ID NO: 31602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcgaggtttccatgctcgtctcggctgga

SEQ ID NO: 31603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcgcaattcaccatcagtgctaatgtgat

SEQ ID NO: 31604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcgcaggtatggtggtcatgcccgcgagt

SEQ ID NO: 31605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcgcgccatgcatctctcgtgcgatgtgg

SEQ ID NO: 31606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcgcgtatgagccacgtctcttgaatgcg

SEQ ID NO: 31607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcgctccggctggtgtttggaatcttgca

SEQ ID NO: 31608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcggactcgcgaccaacacagcttccggc

SEQ ID NO: 31609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcggatccttttgcaacttcgcccctgta

SEQ ID NO: 31610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcggcacactacttgttaccactgtctta

SEQ ID NO: 31611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcggcccgcatgcaggtttttgattcgtg

SEQ ID NO: 31612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcgggctgtaatctcgttctgcagtcgag

SEQ ID NO: 31613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcggtttgccgggggtcaagggtttctgc

SEQ ID NO: 31614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcgtcaagcttatagacgaaaatcgcgac

SEQ ID NO: 31615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcgtgcgcgagactaccttcttccccaat

SEQ ID NO: 31616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttctactgccagggccatacagctgcggca

SEQ ID NO: 31617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttctccgcaaccttcctttacatctggtgt

SEQ ID NO: 31618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttctcctgcggtaattggcttcacagtttc

SEQ ID NO: 31619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttctcgcgtggacttttgtttgcgatgccg

SEQ ID NO: 31620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttctcgtactattcttgtgttccgcttata

SEQ ID NO: 31621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttctctcctaggccgaccctggctttaggc

SEQ ID NO: 31622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttctgaccaaaaattcgacttcagggggga

SEQ ID NO: 31623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttctgggcacactaccaaagccccgaagag

SEQ ID NO: 31624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttctggttggggttatacttagactttccg

SEQ ID NO: 31625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttctgtttgaaaaccccattctcctcgcat

SEQ ID NO: 31626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcttacgggcatgcctggcgagtatatat

SEQ ID NO: 31627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttcttggggaagtaaaactaatttcgggag

SEQ ID NO: 31628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttctttgaggctttagtctcattgcgggcc

SEQ ID NO: 31629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgaaccgcgtgtttttgtgggctatactc

SEQ ID NO: 31630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgaagggaaaaggggaatactggtggtat

SEQ ID NO: 31631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgacaaccagcgggtattggctaccaggg

SEQ ID NO: 31632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgacatatctcggccattccccagtgcga

SEQ ID NO: 31633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgacattctgcgcttcttgtactgggcat

SEQ ID NO: 31634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgaccccgtcaatagtggcgagacagtgt

SEQ ID NO: 31635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgaccggacaacattggaccgccacgatg

SEQ ID NO: 31636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgactatggaggagctggcttcatgcact

SEQ ID NO: 31637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgactgcttctgagctctctatgtgttgc

SEQ ID NO: 31638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgagcaactcgttggcctgcacgattcgt

SEQ ID NO: 31639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgaggtgaatcgcgggtggcggttacggg

SEQ ID NO: 31640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgagtacgggtccgttctttaccagcgtt

SEQ ID NO: 31641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgatcggcgcatacctgggtatctcaagt

SEQ ID NO: 31642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgatcgggccttggtattaacgctcgtgt

SEQ ID NO: 31643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgatgctctcggtactgcttgcctcgatc

SEQ ID NO: 31644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgattcttaattgaaagtgttattacaag

SEQ ID NO: 31645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgcaactgtactgcttcactttgtccctc

SEQ ID NO: 31646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgcacgtttgatattggtgtgatcatgag

SEQ ID NO: 31647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgcaggacagaggtttctccgttctgact

SEQ ID NO: 31648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgcatcgggtgcacgtttccgagggcgga

SEQ ID NO: 31649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgcccgcagacggcgtatgggcttcaaga

SEQ ID NO: 31650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgccgaaagttgcctcggcgtgtgagaat

SEQ ID NO: 31651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgccgaccacgataggagacttatccttt

SEQ ID NO: 31652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgcgagcatacggggccgcgctactaggg

SEQ ID NO: 31653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgcggcgcggaggtcaaggacaagggggg

SEQ ID NO: 31654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgcggcttcggttcaagacagacacctcg

SEQ ID NO: 31655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgcggtgatgttgaattgtcttcatcttg

SEQ ID NO: 31656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgctcgtgcatgattcttgatactcccgg

SEQ ID NO: 31657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgctggtaggaagtgattggagtcgcatc

SEQ ID NO: 31658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttggaccagcatggggcgcacaacagcatc

SEQ ID NO: 31659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttggacttcttgttacacataacgaccgag

SEQ ID NO: 31660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttggatcagcccgcagtaattggttgccga

SEQ ID NO: 31661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttggatgcacaattcagcagcaattgtggg

SEQ ID NO: 31662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttggatggtcctgtttcgttgaaggattta

SEQ ID NO: 31663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttggatttctttcccggtcgctaatccgtt

SEQ ID NO: 31664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttggcaccgaatcctcccgatccttcgagg

SEQ ID NO: 31665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttggcagggtagattgcgtcacccggtcat

SEQ ID NO: 31666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttggccaatgaggtggtagatcttcaacgc

SEQ ID NO: 31667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttggctgaccatgggcctggcacgcgggtc

SEQ ID NO: 31668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgggaagtcaattagagtgagaacgggtt

SEQ ID NO: 31669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgggcaaaagaacagtaaacggctggctg

SEQ ID NO: 31670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgggctacatgcagcgacatctcgggtga

SEQ ID NO: 31671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgggctggcgtatcgcaattcctgtgata

SEQ ID NO: 31672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttggggcggagacggtcacgctgcgagtgc

SEQ ID NO: 31673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgggggctcaattactcggtcgcttgaag

SEQ ID NO: 31674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgggttgtggggcctggagcgcgcgcgaa

SEQ ID NO: 31675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgggttgtgtctccgctcggttaggcttg

SEQ ID NO: 31676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttggtgcaatacaaactactatttgtgaaa

SEQ ID NO: 31677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgtaatgtccggtgcgttggtgattgagg

SEQ ID NO: 31678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgtactaatcggggcttggatcgtggcgg

SEQ ID NO: 31679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgtaggcaaacatcttatcatagtgcagg

SEQ ID NO: 31680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgtataggtcagcgccagacaatgattct

SEQ ID NO: 31681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgtcaagcgtcggagccatgtatgacttg

SEQ ID NO: 31682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgtcatcagggttcccatcgaagggttcg

SEQ ID NO: 31683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgtccatttgggattcgccaggctccata

SEQ ID NO: 31684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgtcccagcgagtccacgcggcttagatc

SEQ ID NO: 31685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgtccgtgaggtgcttgaacatccaatgc

SEQ ID NO: 31686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgtcggtcgtgactttggtttggaagcaa

SEQ ID NO: 31687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgtgaggggtatttctaggagccggtata

SEQ ID NO: 31688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgtgccagcgtgtcttcttttagacgctc

SEQ ID NO: 31689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgtgcgcgctaccgattttggagtatgcg

SEQ ID NO: 31690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgtggactggtgagccaattccgggcagc

SEQ ID NO: 31691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgtggataatctgaatctttgtcacgacc

SEQ ID NO: 31692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgtggcccttccacgtttaccagtaaatg

SEQ ID NO: 31693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgtgtcccggcgtcttattgctatctgca

SEQ ID NO: 31694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgtgttcgtggcaatagggaagtgcggcg

SEQ ID NO: 31695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttgttacttccagtaaatcgcttcacgggt

SEQ ID NO: 31696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttaaacgtgatcctgtctacatgggcgtg

SEQ ID NO: 31697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttaataggcctcgtgaccctctgagcgtc

SEQ ID NO: 31698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttactcacggatccgagcccgtttatgct

SEQ ID NO: 31699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttaggtttagtgttgcggcagggggattg

SEQ ID NO: 31700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttaggttttaccggatatccgcttccaca

SEQ ID NO: 31701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttagtgatggggaacgtgcagtcgggcac

SEQ ID NO: 31702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttattctaacggaaattgctcgttggggt

SEQ ID NO: 31703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttcatgacgacggatcagctgttgttgtc

SEQ ID NO: 31704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttccgtactgttacgcacgtttttccacg

SEQ ID NO: 31705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttccttaaccgctgctcccgcccgtttaa

SEQ ID NO: 31706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttccttacttcgggagaccggtacacttg

SEQ ID NO: 31707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttcgacggggcgggctgcagaggttcgtg

SEQ ID NO: 31708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttcgataccaatcattgaggcgtcttatg

SEQ ID NO: 31709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttcgggttccgggtgtaaaagctatctcg

SEQ ID NO: 31710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttcgtgggacgagcagcactttcaaagac

SEQ ID NO: 31711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttctagtggaacatggctcggacactggg

SEQ ID NO: 31712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttctcagagggcggcgtactacatcacgt

SEQ ID NO: 31713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttctgtaatgcgcgtgtgcgtggatcgtg

SEQ ID NO: 31714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttctgtggtgctgacgtgggaaaccaggc

SEQ ID NO: 31715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttcttcgaggtccaacgcaggtaggcatg

SEQ ID NO: 31716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttcttgttctgggatcatactcttgaact

SEQ ID NO: 31717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttgactgcgttacttgcctggatgagtgc

SEQ ID NO: 31718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttgagcggtttgtcggctatggggttgac

SEQ ID NO: 31719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttgcactagttcaagtttagacgattttc

SEQ ID NO: 31720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttgcatatcatgtgtacgtatgtggggtg

SEQ ID NO: 31721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttgcctgtgtaatacttacggtagtgtac

SEQ ID NO: 31722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttgctcatttgttcattctggaagcgttg

SEQ ID NO: 31723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttgcttcacgtggctgcaccgtgtcgatt

SEQ ID NO: 31724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttgcttgtcgtgttggagatttagccggt

SEQ ID NO: 31725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttggcacctgggcattccttctctgaagg

SEQ ID NO: 31726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttggcattgtaatataagtctgggtacga

SEQ ID NO: 31727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttgggcttctggctagggcgataaagagg

SEQ ID NO: 31728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttggggacttcgcgtatgccagccagcac

SEQ ID NO: 31729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttggtgatggggtgagcctgtatgcttct

SEQ ID NO: 31730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttgtactccgcctagcaattccgctccgg

SEQ ID NO: 31731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttgtctacggtgggagttagcccaagcgg

SEQ ID NO: 31732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttgtgaaccgtcaggtattcctccacaca

SEQ ID NO: 31733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttgtggccgactctgcaacacttgttcgg

SEQ ID NO: 31734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttgtgtcccacgttgttagcttgccgctt

SEQ ID NO: 31735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgtttgttacaaaatgaactgggaagggtgtt

SEQ ID NO: 31736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttttaggatcgtaggggccagtttacggcg

SEQ ID NO: 31737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttttagtggttgtcagtacccgcctgttat

SEQ ID NO: 31738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttttatgccgcaaccgatgaccgagatcct

SEQ ID NO: 31739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttttcaatttatcaaggaccgtatggccgt

SEQ ID NO: 31740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttttccattctggatgttcatcacggtttg

SEQ ID NO: 31741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttttctctcgatcttgcgtttggtcctcca

SEQ ID NO: 31742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttttgaaggcttcgtcgatcgttcgcgacg

SEQ ID NO: 31743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttttgagatcctcgtgcttgtctttatcgt

SEQ ID NO: 31744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttttgcgctaaggtcgagttaagatcctag

SEQ ID NO: 31745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttttgggagtgagtaggtattgttcgtggt

SEQ ID NO: 31746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cgttttgtcataaatggctccgacagcagttg

SEQ ID NO: 31747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaaaacatgcaccgtagaaggcaaaacggt

SEQ ID NO: 31748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaaaacgacgcgaaattagaagccgggttt

SEQ ID NO: 31749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaaaattgggctgcgataaccgggcttttt

SEQ ID NO: 31750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaaacaaaatatgacaacgggtagacgggg

SEQ ID NO: 31751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaaaccatggcagccggaccgatcagtagt

SEQ ID NO: 31752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaaagcgaggttacatcgatattccaacgc

SEQ ID NO: 31753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaaagtgagcttgcagacgagtgtggtgcg

SEQ ID NO: 31754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaaatgaaagaggtttatggccagacttgg

SEQ ID NO: 31755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaaatgactcgagagccaacaaaagttaat

SEQ ID NO: 31756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaaatggatgttcaggcttcggtgggccca

SEQ ID NO: 31757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaaattcatctttgattcgcgcaccgtagg

SEQ ID NO: 31758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaacaccccagcgtcgaattcggtcgctgc

SEQ ID NO: 31759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaacaccgtctagccggtcttggtcccgac

SEQ ID NO: 31760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaaccactggggaccttgcatacataacct

SEQ ID NO: 31761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaaccatttgggcagtcggttttttgtggt

SEQ ID NO: 31762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaaccgtcaccctggagcggcagctggcgg

SEQ ID NO: 31763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaacgacaccagtagcatcaccgcgcattc

SEQ ID NO: 31764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaacgactgcgatgtccttcaacataccac

SEQ ID NO: 31765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaacgatgttgggtggggctgctggtaagc

SEQ ID NO: 31766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaacgcagtgatggacatggggtgctgcgg

SEQ ID NO: 31767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaactcaatctctttttttttagctctggt

SEQ ID NO: 31768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaactgagctgttttgtatgctgcaccctg

SEQ ID NO: 31769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaagaagagggtggctgtcttcaacgcgga

SEQ ID NO: 31770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaagacgctgcggcatgcactgtattgggc

SEQ ID NO: 31771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaagaggcgcaatcggacatgttgaaatgc

SEQ ID NO: 31772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaagcgatcacaaagcgttggcgttcgttt

SEQ ID NO: 31773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaagcgctcggttataccggtttcgagttc

SEQ ID NO: 31774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaagctttagggtggccatctcaaccttgt

SEQ ID NO: 31775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaaggcagtaatatcggaaaagcactgtgg

SEQ ID NO: 31776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaaggtgttaactgtcaggggccgcaggga

SEQ ID NO: 31777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaagtattgtagttttgtgatcgtggggta

SEQ ID NO: 31778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaagtcatgcctgataccaatccttccgtt

SEQ ID NO: 31779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaataagagtgcaattttcagacatgttca

SEQ ID NO: 31780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaatcgttgcgtttccggtgtattggacac

SEQ ID NO: 31781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaatgactggtacgggattctatttgtgcc

SEQ ID NO: 31782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaattcgtgaggttctgtcgcttctttagt

SEQ ID NO: 31783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaattggggtactcaagaacacgtacaaat

SEQ ID NO: 31784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaatttcctagtagacaaaatgttgtgact

SEQ ID NO: 31785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacaagtgtgaaatacgtcaagttcaaata

SEQ ID NO: 31786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacacaggaaagctcatcgggttcaaaata

SEQ ID NO: 31787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacacatgccaaacagtcccaggcctgtca

SEQ ID NO: 31788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacacccttctcccatgtaacgtgcggttt

SEQ ID NO: 31789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacacgagcttatacatcagaacttgttac

SEQ ID NO: 31790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacagcattttgtcgtttctcgtgttttat

SEQ ID NO: 31791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacaggcagtctacgagtggcgggagcacg

SEQ ID NO: 31792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacagtcgttcatccaggataatggcgtaa

SEQ ID NO: 31793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacataccgggtcacgcggaatctagtcgt

SEQ ID NO: 31794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacatccgacccgcatccaagtccctgcgt

SEQ ID NO: 31795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacatgaagccattatgttcttgctattca

SEQ ID NO: 31796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacattcatcatgcgcatcactggtatctg

SEQ ID NO: 31797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacattcgtaggtatggcttatcttgaaaa

SEQ ID NO: 31798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacattgggcgccagatactcgttgtttac

SEQ ID NO: 31799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacatttgtcaagtgcgagctaccgttgtc

SEQ ID NO: 31800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaccaggcgcaacatgttttgatcccgtgg

SEQ ID NO: 31801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaccagtatctcgccgtatcggttaatcgc

SEQ ID NO: 31802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaccatggcctaccagtatggcatgaggat

SEQ ID NO: 31803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacccgaaaccctcgcgctcgtgtgtaggg

SEQ ID NO: 31804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacccgaggattcttctgtttattctggtc

SEQ ID NO: 31805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaccctacctcgccttcattaagttgccgt

SEQ ID NO: 31806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaccgactggcattcaagcgagccgcctca

SEQ ID NO: 31807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaccgactggttctccttgatgttccgtgg

SEQ ID NO: 31808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaccgagcaaaaacgcgaatgctcaatgat

SEQ ID NO: 31809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaccgagcggtctcgtcgtcggcagtggtc

SEQ ID NO: 31810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaccgattattgagagactgtcggagcctg

SEQ ID NO: 31811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaccgtctgcggaactggtctccagatcat

SEQ ID NO: 31812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaccgtgttcccgtaggttctgcacgagga

SEQ ID NO: 31813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacctcggatggtccgcgatctcttgcttg

SEQ ID NO: 31814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacctgaacaccgcgtgtagatcgtcggga

SEQ ID NO: 31815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacctggcccattcttcggtacgcgccgat

SEQ ID NO: 31816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacctgtactcatttatacaattaaactga

SEQ ID NO: 31817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacgacagcttgcctgtacttttcaaaacg

SEQ ID NO: 31818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacgattagttgacgcgcagtagtgccgta

SEQ ID NO: 31819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacgcagtggtcaccgcaattttttgggct

SEQ ID NO: 31820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacgcgatcgatctgggtttccagcgtggt

SEQ ID NO: 31821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacgcggccggcgagcaaggcggtggtgtg

SEQ ID NO: 31822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacggacagacggcggcgacagcggtcatc

SEQ ID NO: 31823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacggctcctgacgcgctctttactatgtt

SEQ ID NO: 31824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacggtcgtagattcatattgggcagccgc

SEQ ID NO: 31825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacgtactctgattcagtgcgaccggccgc

SEQ ID NO: 31826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacgtgcgatactgcgttaattttgagcta

SEQ ID NO: 31827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacgtgtccactggtgtcactttcgggaag

SEQ ID NO: 31828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacgttacctcggcgcagctctattcaggt

SEQ ID NO: 31829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaactcactctggtattatacttttccggga

SEQ ID NO: 31830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaactcgatccagatcattttgcgcagttgg

SEQ ID NO: 31831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaactctcacgcctgcagtcggggccgtgtt

SEQ ID NO: 31832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaactgactgtaggacggcattaggaacttc

SEQ ID NO: 31833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaactgctatgtaacagttctcgcttccatc

SEQ ID NO: 31834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaactgctgagcgctccatatgggcgatcgg

SEQ ID NO: 31835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaactggactagggtactctgaacactatca

SEQ ID NO: 31836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaactgggtggttactggagcccataatgta

SEQ ID NO: 31837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaactgtagctcggcataacgtggataattg

SEQ ID NO: 31838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaactgtgctgagcttcgtggttcgtggtgg

SEQ ID NO: 31839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacttatgggcaactatggagcgactatgt

SEQ ID NO: 31840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacttcacggccttttgagcatgcttaagt

SEQ ID NO: 31841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacttgcactcccatgcccctttgcgtcgg

SEQ ID NO: 31842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaacttgccagttctggtgttgggagctgga

SEQ ID NO: 31843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagaaatcgggtgttaaccagagggtgttg

SEQ ID NO: 31844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagaataatttgctctaatcagtttaacgt

SEQ ID NO: 31845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagacactagtcatgcacagtaatcgctta

SEQ ID NO: 31846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagacgacaactcgctgcacactgccgagc

SEQ ID NO: 31847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagacgttccgtaacggttcgtgatttggg

SEQ ID NO: 31848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagaggaatcactccacggggcgagcggtc

SEQ ID NO: 31849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagatggctgaatagcatatcgtcttgcgc

SEQ ID NO: 31850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagattctggtgcagcagagatggcgtgtc

SEQ ID NO: 31851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagcaagcaacccgcaggtacccaaagtat

SEQ ID NO: 31852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagcccctccaagctatggtgcctgggcga

SEQ ID NO: 31853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagcgacacccgcatgtattcgcggcggca

SEQ ID NO: 31854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagcgagcgatcatatggtctgagggtggt

SEQ ID NO: 31855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagcgcatgaatcggcggactcttgtttgg

SEQ ID NO: 31856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagcgtagcatcggtaagctcctccgttcg

SEQ ID NO: 31857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagcgtatagccatatcaacgtgtgtcggt

SEQ ID NO: 31858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagcgtcagtcaccagagtgtttggggggg

SEQ ID NO: 31859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagcgttataaacagcggctcgtcgcttcg

SEQ ID NO: 31860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagcgttggtttcgttaaccttggcatgtg

SEQ ID NO: 31861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagctccagaatggcgggagggaatcgtct

SEQ ID NO: 31862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagcttagggggcgcgtctgaagtcagcta

SEQ ID NO: 31863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagcttgtccctgtatctcctgtctgattg

SEQ ID NO: 31864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaggaacatcgccactaaccatctgggggg

SEQ ID NO: 31865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaggaaccatgccggaatggtctgttcatt

SEQ ID NO: 31866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaggagaagtgacactcattgagtaatttt

SEQ ID NO: 31867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaggagaggtgaacgtgggctgaccgagcg

SEQ ID NO: 31868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaggagtcctgcgtaaagtctctctgacgt

SEQ ID NO: 31869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaggattcattagacgtcgttctcgaggct

SEQ ID NO: 31870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaggatttggcggaacgttctacccttggt

SEQ ID NO: 31871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaggcgggcactactggtctccccgtcatg

SEQ ID NO: 31872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaggctgtattgatacgcgcacactcgttt

SEQ ID NO: 31873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagggagtgaccggaggaatgtttctcgcc

SEQ ID NO: 31874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagggcatgttccctcactgtccccgtcgt

SEQ ID NO: 31875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagggcgcgacggatgtcggtgtggtctgg

SEQ ID NO: 31876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagggctcacctctgcgattgaacggcggg

SEQ ID NO: 31877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaggggtctggtgaggggtgcggttcggaa

SEQ ID NO: 31878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagggtctgcggcgaggaacttcggtcgtt

SEQ ID NO: 31879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagggtgtgtcggggggtaatcatcagtgt

SEQ ID NO: 31880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagggttgccgcgatagggtgactctgcgg

SEQ ID NO: 31881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaggtccactgcttcttccttgttcagacg

SEQ ID NO: 31882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaaggtccccgttttaatgattcaattgatt

SEQ ID NO: 31883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagtacaggcagcgcaggattggtaatgag

SEQ ID NO: 31884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagtactgcttatcctcaggcgcgtgcagc

SEQ ID NO: 31885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagtagtttcccgcaataacctcggccctc

SEQ ID NO: 31886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagtatcagggaggacgcggccggcacgtg

SEQ ID NO: 31887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagtcatacagcgtcgaaagtggatcgccg

SEQ ID NO: 31888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagtccgcgctcgccccccgagtactatcg

SEQ ID NO: 31889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagtgagcaagcacagaccttcgctcagcg

SEQ ID NO: 31890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagtgatgggatccgtttgatggcttctcg

SEQ ID NO: 31891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagtggtccggtgcatagtggtttacgaat

SEQ ID NO: 31892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagtgtgcaacttattgcgttccgtgggct

SEQ ID NO: 31893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagttacgctcggtgaggatttctgaccgc

SEQ ID NO: 31894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagttagtactcccggtggaataagcaact

SEQ ID NO: 31895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaagtttaaggaagaaagcatcatccgcgcc

SEQ ID NO: 31896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaataacggttggcaggttctgtgaattctc

SEQ ID NO: 31897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaataacttgaagtgatcggtaggcgcaact

SEQ ID NO: 31898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaataaggcaagctccatttctttgacggga

SEQ ID NO: 31899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaataccacagtcccgtcgggcggaatgttc

SEQ ID NO: 31900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatataatgcatttaatcctgtacccgccg

SEQ ID NO: 31901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatatatccggagctatgccctatgatctt

SEQ ID NO: 31902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatatgacaagcctctactccgctgatggc

SEQ ID NO: 31903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatcaacgatgggacaggcggtgttatcgg

SEQ ID NO: 31904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatcaagtggctttcggaagaccatggtgt

SEQ ID NO: 31905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatcagcaagctctaattctacagtccgcg

SEQ ID NO: 31906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatccatactatgccattccacgcttgact

SEQ ID NO: 31907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatccattttgcgattagaatcgaagcatg

SEQ ID NO: 31908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatccgatgtggtgccgtaaactggacgtt

SEQ ID NO: 31909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatccgtacctcagattctcgtgcgccgag

SEQ ID NO: 31910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatccttggaatatgtcggccgatgcgtct

SEQ ID NO: 31911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatcgacggcccgcgttgaaagaagtgccg

SEQ ID NO: 31912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatcgagtattgcgcgcacggctcggcaac

SEQ ID NO: 31913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatcgtacgtcgcatccgttggcctctgct

SEQ ID NO: 31914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatctatctacgacgggcagctcgtacgat

SEQ ID NO: 31915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatgcaaagggcaggttcaagcgttcttga

SEQ ID NO: 31916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatgcaaggttcgtaattaatgatcgatta

SEQ ID NO: 31917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatgccgagtaagatcatgctccactccga

SEQ ID NO: 31918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatgctcgagcaaaactgacgggattcgtg

SEQ ID NO: 31919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatgctgtaaggtcagacgtgggagggctt

SEQ ID NO: 31920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatggaataatgagactgctgggacacgta

SEQ ID NO: 31921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatggcaacccggcagttgcttggtagcac

SEQ ID NO: 31922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatggggaaggtgtcgttgctgcattttcg

SEQ ID NO: 31923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatggttactctcgtgcgcttaacgggctg

SEQ ID NO: 31924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatgtcgtcacacgtagcacatggcatcgt

SEQ ID NO: 31925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatgttagtagtcgctaagctcggtgactg

SEQ ID NO: 31926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaattaacgagcaatgagctcctgcaggatt

SEQ ID NO: 31927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaattacttcacgaagtctgtacctctgccg

SEQ ID NO: 31928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaattagtgatgaagtgggatacggcccgtt

SEQ ID NO: 31929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaattcgtactccagtattgtaattcagtca

SEQ ID NO: 31930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaattgcaattcgatcataactttgggattt

SEQ ID NO: 31931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaattggcgactttggatcttccctcaagcg

SEQ ID NO: 31932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaattgtggattatggatagcagcgggtcgg

SEQ ID NO: 31933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaattgtgggtcgctacgtagggttgcaaat

SEQ ID NO: 31934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatttccgttgttgagttctacaagaagaa

SEQ ID NO: 31935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaatttctacttgatggccgtcaacgttcga

SEQ ID NO: 31936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaaaatgatcaatgctcggtcagtgatga

SEQ ID NO: 31937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaaagtgcagcaattgtaggtattggatg

SEQ ID NO: 31938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaaatgggtgtgggatatctttttccggt

SEQ ID NO: 31939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaaccgagtcgacaccgcatactgaacac

SEQ ID NO: 31940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaacctggtgcttgagatgcattgcagca

SEQ ID NO: 31941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaacgcgtgcactcacaagatcccatggc

SEQ ID NO: 31942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaacgcgttaaggtcatttttcctgcctg

SEQ ID NO: 31943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaacggacgaggtctgcgggtacggcgcg

SEQ ID NO: 31944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaacgggggatacaggcatgctttgtcgg

SEQ ID NO: 31945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaacgtcataggagagcggttcggtgtcg

SEQ ID NO: 31946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaactggcattaagacttggctggtggct

SEQ ID NO: 31947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaacttattggggggtagaacgtcctcac

SEQ ID NO: 31948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaagaaagcgtgggaaataaagcctgcgc

SEQ ID NO: 31949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaaggtcttgtcgctcaatccccttttga

SEQ ID NO: 31950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaaggtgttaatgggatcagcttttgatc

SEQ ID NO: 31951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaataccattgcgttccgaaggtggtggg

SEQ ID NO: 31952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaatgtccgttctttgttgtcgacggttt

SEQ ID NO: 31953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaatttggacttcgactgatcgttgggcc

SEQ ID NO: 31954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacacaacgcgggagttgatcttaggtgcaa

SEQ ID NO: 31955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacacaagcacatgctggagctcgacatcgg

SEQ ID NO: 31956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacacacaaccccgatcactacggattctct

SEQ ID NO: 31957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacacagagagtaacctatcaccccggaccc

SEQ ID NO: 31958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacacagagcgggactattgctttgccgtgc

SEQ ID NO: 31959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacacagcattaattacgtatcttaaccctt

SEQ ID NO: 31960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacacagtgttgacttccgcaaagttgcctc

SEQ ID NO: 31961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacacatgtccgctgctgctcaaataatccc

SEQ ID NO: 31962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacacatttcttgctcctgcattgaaggtac

SEQ ID NO: 31963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaccaagatatgctgagctacaaggtttc

SEQ ID NO: 31964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaccaggtatagcgatcttgtgctgcgtc

SEQ ID NO: 31965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacacccggcatgactagccccagctgcctg

SEQ ID NO: 31966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacacgacctactcggctgtggctcaccgcg

SEQ ID NO: 31967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacacgcagaagcggtcaagaccctaatgta

SEQ ID NO: 31968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacacggcacatccctggatcactcggcatc

SEQ ID NO: 31969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacacgtgccggctaggggggcgcgtgctgt

SEQ ID NO: 31970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacacgttaacacgtcgattatcacttagct

SEQ ID NO: 31971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacacgttttcgggaaccgtagggggatcgc

SEQ ID NO: 31972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacactagattcatactttttcgcccaggtt

SEQ ID NO: 31973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacacttgatcctcccagtaatgcaggtcca

SEQ ID NO: 31974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacacttgcttagatggagtatagactcgtc

SEQ ID NO: 31975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacagaacaagattgacgagccgcatcgagg

SEQ ID NO: 31976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacagattgcggcattggggacgtcaggtgt

SEQ ID NO: 31977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacagcaaacacgttgatctagcgttgtaca

SEQ ID NO: 31978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacagcggcccgccaaatacgactgtgtagc

SEQ ID NO: 31979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacagctgaaccaagggcggcttcgcaactc

SEQ ID NO: 31980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacagcttgtctgctcgatttgggttacgat

SEQ ID NO: 31981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacagctttcccccgttctgtgtctaccgtg

SEQ ID NO: 31982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaggcgaacatggtatggcacaatgccgc

SEQ ID NO: 31983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaggcgcgcaaatcgtcacttcgccagct

SEQ ID NO: 31984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaggcgctcgtactaggctcgggctaggg

SEQ ID NO: 31985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaggctggatccatgttagaagtgggatc

SEQ ID NO: 31986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaggggagccctaccaggttagcgtgaaa

SEQ ID NO: 31987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacagggtccggtgcaggtgttaaagctgtg

SEQ ID NO: 31988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacaggtacttcttggggacttggcgtctcc

SEQ ID NO: 31989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacagtacgcttgtataacttgagtggccgg

SEQ ID NO: 31990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacagtatctagctcctggtgggtatagtct

SEQ ID NO: 31991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacatacatatgggaatggccgttgtggctg

SEQ ID NO: 31992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacatacccaaatcaacatagcttctgtgca

SEQ ID NO: 31993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacatccgtgtcaactgctcacgtgtcatgg

SEQ ID NO: 31994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacatcgtatcagcatctctgtttcgaatct

SEQ ID NO: 31995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacatcttcaaccacctatccgttaagtgcc

SEQ ID NO: 31996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacatgatccctcccactaggaaacgagtta

SEQ ID NO: 31997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacatgatgctctatgggaatcgtcaacgag

SEQ ID NO: 31998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacatgcaagagcttcctccgcatgcgggga

SEQ ID NO: 31999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacatgctattcctgttctggccgtgtgcgg

SEQ ID NO: 32000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacatgctggacaggcaccatctcctgcggg

SEQ ID NO: 32001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacatggtttatgcgttagtgtcgcgtttaa

SEQ ID NO: 32002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacatgtggacaatcctggaccaccggtgat

SEQ ID NO: 32003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacatgttgattcaccagtaactgcgccccc

SEQ ID NO: 32004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacattacaaagttagtgttagagggctgcc

SEQ ID NO: 32005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacattgacctgaatggcccgggttccacga

SEQ ID NO: 32006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacattgcgctcaagtgtacggtgtcgcccg

SEQ ID NO: 32007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacattgggatacagtgcgagttccatttga

SEQ ID NO: 32008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccaaatgctgaccggtgcagggacgcttt

SEQ ID NO: 32009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccaacacgttcgacgggaagtgggcgttt

SEQ ID NO: 32010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccaacatagagagctccgattcctggcac

SEQ ID NO: 32011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccaaccatgactcatccctcgttgggccg

SEQ ID NO: 32012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccacagatactaagcaaactactgtgcct

SEQ ID NO: 32013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccacatctttccttgatgtcacgctcgtg

SEQ ID NO: 32014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccacatgcagtggatttggtgacgtgctg

SEQ ID NO: 32015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccacgcccacgtgtggatctggtcccttg

SEQ ID NO: 32016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccactactgaaaagctgtgaaatgaaaac

SEQ ID NO: 32017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccagagatgggaggtcagccgttgttgga

SEQ ID NO: 32018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccagcaaacggctaatttgtagaatcgcc

SEQ ID NO: 32019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccagcggggtgataagtatttccagtatg

SEQ ID NO: 32020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccagtcaacttgtcgtcttctcaggctcc

SEQ ID NO: 32021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccatccacgaaatgtttagggtgagttgc

SEQ ID NO: 32022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccatgaagtgaggtgaccaagtataatag

SEQ ID NO: 32023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacccaaacctagcgttccatgctcgacgtt

SEQ ID NO: 32024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacccacaccaaatccggaggaatcccgtgt

SEQ ID NO: 32025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacccacatgccatgtgcgatcctctcctgc

SEQ ID NO: 32026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacccactggtgtatggactctcgtctgcga

SEQ ID NO: 32027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacccaggttccaacattcatggccctccgt

SEQ ID NO: 32028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccccacgccgtgccataagttacgtgaca

SEQ ID NO: 32029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccccggaatgggctgcaactgccctctga

SEQ ID NO: 32030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccccgttaaatgttcatttaaggttggga

SEQ ID NO: 32031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacccctgtggcgggtggagggctttctttc

SEQ ID NO: 32032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacccgatgctgtgttcatgtcctcgttgaa

SEQ ID NO: 32033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacccgggaaggtatcgatccgactactgcg

SEQ ID NO: 32034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacccgtctacctacggatgctacgtctcgc

SEQ ID NO: 32035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccctcagttttcttatcttgatagactgc

SEQ ID NO: 32036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccctcatgtccaaataacagtgacgcatg

SEQ ID NO: 32037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccgaacctgtgtggcgtctggggcgttgg

SEQ ID NO: 32038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccgagcctgtttttggcttttagaagttc

SEQ ID NO: 32039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccgagtgattggtgggtttcgagtaggtg

SEQ ID NO: 32040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccgataagtccgggttaattttagtagtg

SEQ ID NO: 32041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccgatgcccttaagggtgcttgcatattt

SEQ ID NO: 32042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccgctttagcaggaattagctttctctcg

SEQ ID NO: 32043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccggacagtgcaaggtcactatacactta

SEQ ID NO: 32044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccggcgtgaatgggtgcaccagttatctt

SEQ ID NO: 32045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccgggataagggatccgtgtagtcccgcg

SEQ ID NO: 32046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccggggttccagtacctaagtctgtggtt

SEQ ID NO: 32047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccgtaagaacaagctctaattgcgtggct

SEQ ID NO: 32048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccgtatgcatcggtcaggaggggagctag

SEQ ID NO: 32049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccgtcatcaatctccctgtggtctcaatg

SEQ ID NO: 32050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccgtggtctggtggcctttcactatgcgg

SEQ ID NO: 32051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccgtgttccgtctggttcttgccttgagc

SEQ ID NO: 32052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccgttgcgcacctgaagtagtctttgttc

SEQ ID NO: 32053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacctaaacttgagatgcgtatcacacctga

SEQ ID NO: 32054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacctaaggttgttctgactccgttctgtgg

SEQ ID NO: 32055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacctacggccaacgatcctctgagctttgc

SEQ ID NO: 32056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacctagcgtgctcgttgtgtttgctcatat

SEQ ID NO: 32057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacctatcaaacgggaggtccccagaatgct

SEQ ID NO: 32058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacctatcgcgcgtaccgcaggaacagggcg

SEQ ID NO: 32059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacctcccggtgtacatgcggatatcgatcg

SEQ ID NO: 32060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacctccgctcgttgttcttcttcaatctgg

SEQ ID NO: 32061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacctgccctacgctatctttcattgcattc

SEQ ID NO: 32062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacctggcccgcgcttataacgacgatgttt

SEQ ID NO: 32063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacctgggcctcccgtattgagaagaggctc

SEQ ID NO: 32064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacctgtcaaacgggcagaacaccgggtcgt

SEQ ID NO: 32065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaccttcttggcgatagcaaggctactacgc

SEQ ID NO: 32066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgaagatggcaggtctctgtgatcgtcga

SEQ ID NO: 32067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgaatattgatagtcatgcaggtgtagtg

SEQ ID NO: 32068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgacaatgatattcagttacgcgcgtgag

SEQ ID NO: 32069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgacacactgtcggagagcgggtcagata

SEQ ID NO: 32070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgacccctttgcttgagtactgctgtccg

SEQ ID NO: 32071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgacccgagatctcaaccgccccagggat

SEQ ID NO: 32072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgagcactgtgtacgttactagtttggta

SEQ ID NO: 32073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgagcgcatccgtactactccaaaatggg

SEQ ID NO: 32074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgagttgttctgcatagtatcaagttggg

SEQ ID NO: 32075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgatcacatgcgatccgtaggttggagtc

SEQ ID NO: 32076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgatcggcatatttcggctgggcgcgcaa

SEQ ID NO: 32077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgatggaggtggtgtggttcaacatcggt

SEQ ID NO: 32078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgatgtgtgtcactgtcgacggctcgata

SEQ ID NO: 32079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgattggctcgagcgttcagtttaagagc

SEQ ID NO: 32080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgcaaggcatggatttatctacagctggt

SEQ ID NO: 32081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgcaccgacagggatctccgactgctacg

SEQ ID NO: 32082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgcactttgtacccgtccacactatctgt

SEQ ID NO: 32083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgcagcggcttgtgagttgcgatggtgtt

SEQ ID NO: 32084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgcatccaggcatgtccataaggacgcgg

SEQ ID NO: 32085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgcgacagagctcctagcccagtgcaatc

SEQ ID NO: 32086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgctatttgtccctcgtagtgaggcatca

SEQ ID NO: 32087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgctcggatgcttgttcacgggcaggtct

SEQ ID NO: 32088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgctgataatccgagacacgcgccctatt

SEQ ID NO: 32089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgctgcatggaagggtctttagcgccctg

SEQ ID NO: 32090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgctgtgaacttaatgtcatgtaatccaa

SEQ ID NO: 32091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacggaacgaaatctgcatcggcgtatcctt

SEQ ID NO: 32092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacggaaggatcgctacagtctaatggcatc

SEQ ID NO: 32093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacggaagtcaaagggctcggcgggtggggt

SEQ ID NO: 32094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacggagcattaatcgttcagtcggggcagc

SEQ ID NO: 32095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacggatttcatatggtggaccctgctgtgc

SEQ ID NO: 32096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacggcaattttgaaaaggggcgtagagggt

SEQ ID NO: 32097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacggcagaacgctcgataagggttggtcgt

SEQ ID NO: 32098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacggcagaagcggcgggctgaatggtcatg

SEQ ID NO: 32099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacggcggatggtttgaggacacggcggata

SEQ ID NO: 32100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgggaactacgtttgaggcgaggtgcggc

SEQ ID NO: 32101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgggagcgacggagtagacaagaacccgt

SEQ ID NO: 32102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgggccgtagttccgggttccggttttcc

SEQ ID NO: 32103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgggcggcactggggtgcagacagctcct

SEQ ID NO: 32104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgggctagcctgtcaactaatggcgggtt

SEQ ID NO: 32105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgggggatgacgtaacgtctagcgtcgcg

SEQ ID NO: 32106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgggggctccatgactcatgccttaggtg

SEQ ID NO: 32107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgggtggggcaacatgcggctctcccttc

SEQ ID NO: 32108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgggttagataagaactggcggccctcga

SEQ ID NO: 32109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacggtacgatggattgccagggtgcgcggc

SEQ ID NO: 32110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacggtacgccttatctttcccctcgtccgc

SEQ ID NO: 32111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacggtatgcactacggcagcgatggttgct

SEQ ID NO: 32112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacggtcgtcattgttctacgcacccgagac

SEQ ID NO: 32113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacggtgccaaaggtgcggaggatcaacgtt

SEQ ID NO: 32114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacggtggcctctcctaaagctgtttggaag

SEQ ID NO: 32115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacggtggtggctacaggagggggtcggtcg

SEQ ID NO: 32116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgtacagcgggtatgggtgtgtgtctaat

SEQ ID NO: 32117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgtagcgaggtgcggtgatagtatggtct

SEQ ID NO: 32118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgtaggggtgctctttagaggatatgggg

SEQ ID NO: 32119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgtaggtcgggtgtggtgttcatatggtg

SEQ ID NO: 32120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgtataggactgtgccagcattgcttgcc

SEQ ID NO: 32121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgtatgatcctcgaaaaatatattcggcc

SEQ ID NO: 32122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgtcagggcggatgtgggggacctggccg

SEQ ID NO: 32123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgtgatccctctaaatacctgcgccggtg

SEQ ID NO: 32124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgtgatcgattcatcttgcggtgtaaagg

SEQ ID NO: 32125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgtgctgtgactgtggatgctgtgactcg

SEQ ID NO: 32126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgtgctttggtgacttctcgcctcccgca

SEQ ID NO: 32127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgtggaccgtgttggctttggtgtgctgc

SEQ ID NO: 32128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgtggagcgctattgagaacgtattcagc

SEQ ID NO: 32129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgtgtgaggttggatgtgggtataaccta

SEQ ID NO: 32130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgttcctacaccgctcggccgttgaatct

SEQ ID NO: 32131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgtttcataggggggtcaacgcagtgttc

SEQ ID NO: 32132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacgtttcctgaagtacgcgatccggttgat

SEQ ID NO: 32133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactaactgggagtcggttagagcccttgca

SEQ ID NO: 32134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactaccatgttatccgtgcgtacgtcatgt

SEQ ID NO: 32135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactaccgattcaggaaagtgcccggatgag

SEQ ID NO: 32136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactacgtatcatctgtgcgaggcttgcgag

SEQ ID NO: 32137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactacgtggtgtcattatttgtgcgtggtt

SEQ ID NO: 32138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactacttataacgataggcatactaacgga

SEQ ID NO: 32139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactacttcactctcgtatctctaagacttg

SEQ ID NO: 32140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactagcagcgggcacgatctagtaacagtg

SEQ ID NO: 32141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactagcggcgggctcgggtccgggtgatgg

SEQ ID NO: 32142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactagctgtgtgttggccgtctctggggca

SEQ ID NO: 32143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactagtgcgggtgttggaaagtaagttatc

SEQ ID NO: 32144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactatccactgccagtcaaccgtacacatg

SEQ ID NO: 32145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactatccatgtgcggtcttgatacgggcga

SEQ ID NO: 32146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactatccgccctgttagctagtgccaggca

SEQ ID NO: 32147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactatggcgcatattttccctgccaaacgg

SEQ ID NO: 32148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactatgggcctaacacaaaccactaccgtt

SEQ ID NO: 32149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactatgtagtgtactggttctacctactgt

SEQ ID NO: 32150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactattatgtctttcatgtagtccacgtaa

SEQ ID NO: 32151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactcaacgatcgtactcggcggacgtcggc

SEQ ID NO: 32152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactcagcggatcttgagtgggggccgcgtg

SEQ ID NO: 32153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactcagggagtgctaccggggcaggatttt

SEQ ID NO: 32154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactcatcatcgtacgcatttggctgagtct

SEQ ID NO: 32155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactcatggtggtatcgttctttgcgcgtgt

SEQ ID NO: 32156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactcatgtgcggttcgatttgcgaatctcc

SEQ ID NO: 32157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactccaagatgtatcgccacgttctagctg

SEQ ID NO: 32158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactccaggtcggcattccctcgcgaccctt

SEQ ID NO: 32159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactccccatttttcattccctgccctgttc

SEQ ID NO: 32160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactcccgggaaccgcccacgttggtctctg

SEQ ID NO: 32161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactccgtggctgtgccaaatcgtttgtccg

SEQ ID NO: 32162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactcgaacaagcaaatatcacgtcccccct

SEQ ID NO: 32163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactcgagaactgtataggtgggagtcagat

SEQ ID NO: 32164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactcgaggtaacaccgtgggaggggatggg

SEQ ID NO: 32165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactcgcaaccaacggggaaaatggcgggcg

SEQ ID NO: 32166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactgcagagtggtcccaggctgactcaggt

SEQ ID NO: 32167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactgcattatggtgatctggaatcgatagg

SEQ ID NO: 32168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactgctccgtacgcctctctgcaattgtgc

SEQ ID NO: 32169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactggaatgtcgacaccgtgcacgtcccac

SEQ ID NO: 32170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactgggcggggtaaaggtgtgtggggaggc

SEQ ID NO: 32171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactggggacggtagcttccagcgttgttcg

SEQ ID NO: 32172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactgtcgacctcctacggcgcttccgttct

SEQ ID NO: 32173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactgtgctacgggtttagtcactctcggaa

SEQ ID NO: 32174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactgtggggcgtcttaggtggtcactcgtg

SEQ ID NO: 32175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactgtgtcgcgaataatagcaggatttgcg

SEQ ID NO: 32176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactgtttacgggaaacgcgtggtattcact

SEQ ID NO: 32177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacttatcgagttgagatatagtccccgagc

SEQ ID NO: 32178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacttatgcctcggtgatttagcctggaaat

SEQ ID NO: 32179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacttattatgcgaatggccggttgtccacc

SEQ ID NO: 32180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacttattcggttctagccttcgcacattgg

SEQ ID NO: 32181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacttattggcaccacacgagtcagcatact

SEQ ID NO: 32182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacttccactaacatgctccgtattatgcgc

SEQ ID NO: 32183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacttcggaaaacttaaattatctccgataa

SEQ ID NO: 32184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacttctagtatgagcagaattaacccttgg

SEQ ID NO: 32185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacttgcaacacagtcgacggaccttttgtt

SEQ ID NO: 32186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacttgccactcgctccctggtgccttgacc

SEQ ID NO: 32187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactttacgcggcacagtaccgttctggaat

SEQ ID NO: 32188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactttctccgggaggtctatacaattgtct

SEQ ID NO: 32189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctactttggattatttgagatccctttccccg

SEQ ID NO: 32190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacttttaacccatcatggttatatattgca

SEQ ID NO: 32191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctacttttggtgtttggttcacattacttcgg

SEQ ID NO: 32192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaaagacatgccaggcactaccgccatcg

SEQ ID NO: 32193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaaataagcgtagggatcaaatgcatctg

SEQ ID NO: 32194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaaattccctggttggcgtttaacgattg

SEQ ID NO: 32195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaacggagcgtctgtaattaccgggcggg

SEQ ID NO: 32196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaacgggttctgtgggatgtgttcgctga

SEQ ID NO: 32197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaactgccaatacacatctagtcagtccc

SEQ ID NO: 32198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaagtgtcaggacctcacgcggcgtcttg

SEQ ID NO: 32199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaatactcaaatagagctgtgcacccgga

SEQ ID NO: 32200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaatagagaacttttttggtaataacacg

SEQ ID NO: 32201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaatgactggggctctagttcgctctgaa

SEQ ID NO: 32202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaatgagtggaccggtacgtctgcaactt

SEQ ID NO: 32203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaattgctgttggtctggcccttcatctg

SEQ ID NO: 32204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagacaaggctgggtacatgtcgggtggcgc

SEQ ID NO: 32205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagacaatggggcaaggatgcagctatgccc

SEQ ID NO: 32206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagacagtggtagtggactaaaattaggtta

SEQ ID NO: 32207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagacatcgaattgtgtcgcggattcaggcc

SEQ ID NO: 32208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagacatgaaaacaatatcttcgacgattgc

SEQ ID NO: 32209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaccaatagctctgccgcggttgcgtgtt

SEQ ID NO: 32210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaccgccagggacttatgactgaaatgcg

SEQ ID NO: 32211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaccgccggacagcagtgatgtggcaacc

SEQ ID NO: 32212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagacctcgcgcgggcaaattgcacggctag

SEQ ID NO: 32213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagacctcttagcgacacatacgagaggcca

SEQ ID NO: 32214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagacgactgccgtagagaaagccacggagt

SEQ ID NO: 32215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagacgcgggtgagttactggcgctctaccg

SEQ ID NO: 32216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagacggtacctggggtcactcgtggtctag

SEQ ID NO: 32217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagactggacaagtccgaatcgtggaccctt

SEQ ID NO: 32218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagactggtccctgacaaagttatgcgacgt

SEQ ID NO: 32219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagactttgatatggggcttgacatcggtga

SEQ ID NO: 32220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagagacctgtagaccttattggcatacacg

SEQ ID NO: 32221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagagcacccacctggatcgggttgtgtgta

SEQ ID NO: 32222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagagcaggtctgataggttataatagaagt

SEQ ID NO: 32223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaggagagattaggaccaatgactaaccc

SEQ ID NO: 32224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaggcgtcggaatggcttcgcggccttgg

SEQ ID NO: 32225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagagggtaatcacccaggtgagaaactaag

SEQ ID NO: 32226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaggtaccacgactattattgaggtctcc

SEQ ID NO: 32227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaggtactacccgtccgagctgtaatgtc

SEQ ID NO: 32228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaggtccctcgaaattgcggttatgacgt

SEQ ID NO: 32229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagaggttcctgatccgtaatcattgggttt

SEQ ID NO: 32230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagagttcccaggcgtgatcaacactaactt

SEQ ID NO: 32231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagatagttgcacatggagcaccgatgggtc

SEQ ID NO: 32232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagatgcacgtaatgccgagggacatcagat

SEQ ID NO: 32233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagatggggtaaattagtgtatagtgccgga

SEQ ID NO: 32234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagatggtaattggaggtagttactacattt

SEQ ID NO: 32235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagattcaatttgactaccagatcacttgag

SEQ ID NO: 32236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagattccatctttcccggttcaaacaacct

SEQ ID NO: 32237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagattcccccctgcactacattacctgacg

SEQ ID NO: 32238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagattgctccgatcgtatcgttgacggatt

SEQ ID NO: 32239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagatttcgtaaggagggagtcacgcgtgtg

SEQ ID NO: 32240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagatttgaaaagcggtctttattagctagg

SEQ ID NO: 32241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcaaaagcagtggggggttcagctgacgt

SEQ ID NO: 32242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcaaacgtggagagggaagtggctagcgg

SEQ ID NO: 32243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcaacatccgaataagtgtagagcgaggc

SEQ ID NO: 32244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcaaggattcgacagtatatgcgtggaat

SEQ ID NO: 32245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcaatctgtcgcaaggtgtttccgaaccc

SEQ ID NO: 32246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcaattgtttatcgtactctgactttgtt

SEQ ID NO: 32247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcactcttattctggttccacgatgacat

SEQ ID NO: 32248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcacttcgttattccgtctcatagagaaa

SEQ ID NO: 32249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcagctgcggtatcctgctgaggcatcgg

SEQ ID NO: 32250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcaggtaattccctcctacactgggtctt

SEQ ID NO: 32251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcaggtgaatgatgcactccaagcaggtg

SEQ ID NO: 32252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcagtggaagacaaggaggtctcgcaggg

SEQ ID NO: 32253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcataccgccccgttaactcaatctcgtt

SEQ ID NO: 32254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcatatgccggctaaaagtgtctcattgg

SEQ ID NO: 32255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcatctgacccgtctagtttagcgcccac

SEQ ID NO: 32256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcatgcacgagttaatttgctgctaaccg

SEQ ID NO: 32257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagccaagtaattgatagtctccccgtgctc

SEQ ID NO: 32258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagccaccaaggcggtccgacgtggggaacc

SEQ ID NO: 32259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagccagagaagccccgccccttcaccgtct

SEQ ID NO: 32260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagccagccggacagcagaggaggggtgaac

SEQ ID NO: 32261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcccaaaccggttcaccaggattctcgtt

SEQ ID NO: 32262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcccaacggagagagtgcaagaagtgtgg

SEQ ID NO: 32263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcccagcagatgacaggcgtgcgtggcgg

SEQ ID NO: 32264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcccagcggggcgggtgtcttaacgctgg

SEQ ID NO: 32265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcccctactctcatgtgtcaccctcactc

SEQ ID NO: 32266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagccctagcgtggcctccccgactagggtc

SEQ ID NO: 32267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagccgcgacacaggaatcgttcggtgcgac

SEQ ID NO: 32268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagccggattgagagtcttaacgtgtggcct

SEQ ID NO: 32269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagccgtgcttttcagtcgcagcttgcgtca

SEQ ID NO: 32270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcctcttcaggtatttcgtgacgttgtcc

SEQ ID NO: 32271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcctgcaaatttcagcgtacccttccgcg

SEQ ID NO: 32272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagccttcaaggttgctaacagagctcgtga

SEQ ID NO: 32273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagccttctatcacctcctgcttgatgctcg

SEQ ID NO: 32274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcctttctgtcacgcgtgtatgctatctt

SEQ ID NO: 32275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcgaacacgggccggagttgttccccttg

SEQ ID NO: 32276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcgacctttcatcagatgccctgtcggat

SEQ ID NO: 32277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcgataccgcgaatccgtacaaggtcgga

SEQ ID NO: 32278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcgcatgttgcggtcttctaggactactc

SEQ ID NO: 32279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcgcgaccagagttgatatattagtgact

SEQ ID NO: 32280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcggaccacacatacgttcttacctctgg

SEQ ID NO: 32281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcggaggtgactttcccgccagctcttct

SEQ ID NO: 32282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcggagttcggacaacccgacgtcacagc

SEQ ID NO: 32283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcggataaaagttagattaaccgcatgtg

SEQ ID NO: 32284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcggctgagggcgtttgtactgagcaggc

SEQ ID NO: 32285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcgggaaacacggtgaggaaatccagact

SEQ ID NO: 32286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcgggataccaactcgatcatgagtaggt

SEQ ID NO: 32287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcgggtgaggtcctaggattccttccggg

SEQ ID NO: 32288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagctaactaatacagaagccagtgcataat

SEQ ID NO: 32289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagctacaaactaaatgcgactgtttttccg

SEQ ID NO: 32290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagctacacgcgctcggagatattagtaggc

SEQ ID NO: 32291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagctaggtccatatatcgaacctcagtctg

SEQ ID NO: 32292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagctcacgaataactctcggcaaacgtagt

SEQ ID NO: 32293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagctcgcggcccggtggtgtggcgagtgtg

SEQ ID NO: 32294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagctcgcggcgcagggtactcttccgcgga

SEQ ID NO: 32295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagctggttcccgcgtgattgttcgctcgtt

SEQ ID NO: 32296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcttacgtctccattgagtttcggcattg

SEQ ID NO: 32297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagcttatcatccttatcttcgagtcgcggt

SEQ ID NO: 32298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggaaccggtctaaacacgcggagtgcctc

SEQ ID NO: 32299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggaagcaagcgtcaattgctgttattatg

SEQ ID NO: 32300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggaagcggtcatgatagggtgcaattccg

SEQ ID NO: 32301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggaccactcaaagcgattgcggggtgccg

SEQ ID NO: 32302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggactatgttattccgtcccgttactgtc

SEQ ID NO: 32303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggacttgcctgagtgtgtgcaatgtttaa

SEQ ID NO: 32304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggagccgaagcagcctacgggttacgcat

SEQ ID NO: 32305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggatatagttactcgaccagcccgtgtga

SEQ ID NO: 32306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggatgtatcgagacctcaccccatcacgc

SEQ ID NO: 32307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggattcatccctcgacgatacgtagtttg

SEQ ID NO: 32308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggattcccttaccgtcataattaaagagc

SEQ ID NO: 32309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggattgatggacctcgcagatattgtggg

SEQ ID NO: 32310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggcaagcacgcgtctagtactccagttat

SEQ ID NO: 32311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggcaatcaccaatatgacctgctcgttca

SEQ ID NO: 32312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggcacggacgtactaaacccttgtgtcgc

SEQ ID NO: 32313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggcagtgtctgtcgtacgactctcgttta

SEQ ID NO: 32314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggcagttgaagaattttgtcgtttaggcg

SEQ ID NO: 32315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggcataggattacagctcgggatcgccac

SEQ ID NO: 32316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggcatgctggttcacctgtgatctcgatt

SEQ ID NO: 32317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggccaatcttgtaggtagcgtgctatgga

SEQ ID NO: 32318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggccgctgaggaggggaaccgtgctaggc

SEQ ID NO: 32319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggcgcgcaccccatgactgagttcgtacg

SEQ ID NO: 32320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggcgcggcgctcagtacatgacgaagacg

SEQ ID NO: 32321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggcggacgtcgagggggggtcgtaagggt

SEQ ID NO: 32322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggcgggcaaacatcctggctcggattttt

SEQ ID NO: 32323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggcgggcgatttcatggacctcagttgca

SEQ ID NO: 32324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggcgggttaggctatgagagtagcgggga

SEQ ID NO: 32325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggcgtatttgaagctcgcaacgcattagg

SEQ ID NO: 32326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggcgttagataagccggcttaacgggctg

SEQ ID NO: 32327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggctaggaaaccccagtgcggtaccgatg

SEQ ID NO: 32328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggctcgcgtcgatcacagtgtcgacctat

SEQ ID NO: 32329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggctcgttaaggggtagggctgatacccg

SEQ ID NO: 32330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggctgaaggttggagtacgcacttccagg

SEQ ID NO: 32331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggcttaatctctcgcccaggccgcgtgta

SEQ ID NO: 32332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggctttgccaattcctgctgataaaagct

SEQ ID NO: 32333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggaagcagtgtgcctgacagacggtgca

SEQ ID NO: 32334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggagacacggctcggcttctcgttcggt

SEQ ID NO: 32335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggagatagtggggacggcatacgggatg

SEQ ID NO: 32336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggagttttgtgcccgactagcgagcatc

SEQ ID NO: 32337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggatcacttgcatatgctgcgacgactg

SEQ ID NO: 32338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggattgctcactggatccacatcatcat

SEQ ID NO: 32339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggcaataccggtccaggagcattcacgg

SEQ ID NO: 32340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggcaatcttcatactttcagctcaagtg

SEQ ID NO: 32341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggcaggcgatgtcccctgtggtccctac

SEQ ID NO: 32342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggcataccttactagctatggctctcgt

SEQ ID NO: 32343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggcattcaccgcttccgttcgcttatgg

SEQ ID NO: 32344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggcgcaagaatgtggttgtggttccccc

SEQ ID NO: 32345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggcggctggattccgcatttgggtctgg

SEQ ID NO: 32346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggcgtttgtctatttggtaggttttcat

SEQ ID NO: 32347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggggcatctgcgctccttcgacggcactt

SEQ ID NO: 32348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggggggactgatttttgttgtgcatgggg

SEQ ID NO: 32349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggggggccgcaccgtgtggggatgttcgt

SEQ ID NO: 32350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggggttcatatctcattgcggtctcttc

SEQ ID NO: 32351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggtactaaaaattggcaagggccgctgt

SEQ ID NO: 32352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggtctcgggactctttttaaacacaagt

SEQ ID NO: 32353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggttattcgtcgtagcatgagcactttc

SEQ ID NO: 32354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggttatttattcccctgagtattgggta

SEQ ID NO: 32355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagggttttaccggtaccgtcccgtttcgct

SEQ ID NO: 32356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggtaattggttcgacggtgtgcacggagt

SEQ ID NO: 32357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggtaatttggaatctttagtattgtttgt

SEQ ID NO: 32358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggtacttaagatatcattcagtatttcga

SEQ ID NO: 32359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggtagaccttgagagcggtggggctaaag

SEQ ID NO: 32360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggtctattgatgaagtgatgcccggaggg

SEQ ID NO: 32361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggtctgatatgcgcgcaggccacgttgaa

SEQ ID NO: 32362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggtgacggtgaagtttctggggctcgtgg

SEQ ID NO: 32363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggtgcccttgcaatccgttgccttgccct

SEQ ID NO: 32364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggtgcgcatccgccgtgtaacagttggcc

SEQ ID NO: 32365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggtgcggcggtacaaagacggatgtgtcg

SEQ ID NO: 32366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggtgtctaaaagttatgaaccgggcatta

SEQ ID NO: 32367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggttcgcaagtgtagatgtagagttttga

SEQ ID NO: 32368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggttcggatccatctactcttgtttacgc

SEQ ID NO: 32369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggttcggatcggttatatttacccggaga

SEQ ID NO: 32370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggttcgtcccttatctttagttcgttgaa

SEQ ID NO: 32371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctaggttgtgtcagaacgcaatgtagcaattg

SEQ ID NO: 32372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtaacacaggccaggtatggtcccgacat

SEQ ID NO: 32373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtaacgtttgataatttatgcagaaggtg

SEQ ID NO: 32374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtacaacagctaataagcctgtgcattgt

SEQ ID NO: 32375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtacaatacgacgcagtatttgagcgccc

SEQ ID NO: 32376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtacactcgacatacgcgtggaggggagt

SEQ ID NO: 32377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtacgttagtatacacgcgggccggctga

SEQ ID NO: 32378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtatgggctccttaatgtgggattcccga

SEQ ID NO: 32379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtcaacgtcaggtgtagtgggagcccggg

SEQ ID NO: 32380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtcacgttcgctcaaattaagaacgtggc

SEQ ID NO: 32381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtccataaggtactatagaattggcgcca

SEQ ID NO: 32382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtcccatacgttacagtcacctttgtcac

SEQ ID NO: 32383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtccggacggctgttctacttatacacca

SEQ ID NO: 32384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtcgcccgtctcctcctcgtgcaatttgt

SEQ ID NO: 32385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtcgccttcggacctgcactatcgtcttg

SEQ ID NO: 32386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtcgctactgaaagatccaagcgcctggg

SEQ ID NO: 32387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtcggcaccgtttcatacgaacaagtaga

SEQ ID NO: 32388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtctcctccgtcagagctcacagagactg

SEQ ID NO: 32389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtctgagggtcatcgcgacatcaagtgcg

SEQ ID NO: 32390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtgcaatgtttcgctaataggactgttat

SEQ ID NO: 32391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtgcgacatattcagctcgcctcctcgcc

SEQ ID NO: 32392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtggaactatttggattgacgtcagcctt

SEQ ID NO: 32393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtggacgcatgtcccgctcagcggccctg

SEQ ID NO: 32394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtggcaagtcagggggtctgggccaatcg

SEQ ID NO: 32395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtggcagatggcaagagtttcggaataga

SEQ ID NO: 32396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtggccttccctgttaacgtgattcaggt

SEQ ID NO: 32397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtgggagtttgtttgtagaaggatccatt

SEQ ID NO: 32398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtggggggttgtgatcttgacacgtagga

SEQ ID NO: 32399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtggtgtaagggtgcgtaggttgggtggc

SEQ ID NO: 32400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtgtaaggctcgtatgaatcatacaacgc

SEQ ID NO: 32401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtgtcccggttgtgattgcacttatgggg

SEQ ID NO: 32402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtgtcgaccgtgtcccctcgtgatctgtt

SEQ ID NO: 32403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtgtcgaggttgggttgcttatctcgccg

SEQ ID NO: 32404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtgtggtacaagtctcatacgtgcaggct

SEQ ID NO: 32405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtgttctgattaatccattcgtccgctcc

SEQ ID NO: 32406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagttaagtgcggcttcctactcatccgaca

SEQ ID NO: 32407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagttatgacgacgtgggtggcgattactgg

SEQ ID NO: 32408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagttcagacgacccccatgtcgcatcccgc

SEQ ID NO: 32409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagttcaggcgtgttcttaggggcttcaggg

SEQ ID NO: 32410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagttccactaatgggcaccatgtttacaaa

SEQ ID NO: 32411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagttccctgtactttaaaatcagccttacg

SEQ ID NO: 32412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagttcgccaaggtggtgaaggcttcgcgct

SEQ ID NO: 32413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagttctacactctgtagctctcttatcggc

SEQ ID NO: 32414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagttgacgggttgtgtgtggctagccttgc

SEQ ID NO: 32415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagttgatgagtactaaacaggccacacggg

SEQ ID NO: 32416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagttgcaccggtttagacaactgtgtttgt

SEQ ID NO: 32417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagttgcacgctgtaaatgctgattgcgtga

SEQ ID NO: 32418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagttgcatgttgccaaatgcgtctcgggag

SEQ ID NO: 32419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagttgcggactttggacttgcgccgaactt

SEQ ID NO: 32420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagttgtgggatgacgcaaaattctaagctg

SEQ ID NO: 32421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagttgtgtcatgtgcgcgcatacgggtaac

SEQ ID NO: 32422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtttagctcgagtggcgcggctggaagta

SEQ ID NO: 32423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtttctatacttgagttaaattctgtttg

SEQ ID NO: 32424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagtttgaccagtaacaccggaccacgatac

SEQ ID NO: 32425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctagttttccttgtttaggtttgccgctagat

SEQ ID NO: 32426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctataaaagtcggtatgcgggatcactttgta

SEQ ID NO: 32427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctataaacaggacgctttatggttcttagaat

SEQ ID NO: 32428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctataaaggcggttattgagatttacaggcat

SEQ ID NO: 32429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctataacacgcatccccaagcaatcttattat

SEQ ID NO: 32430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctataacagggattcccgcaacatcgcaaagt

SEQ ID NO: 32431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctataacgacgatcgctcaatctataattagt

SEQ ID NO: 32432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctataacggtatccgaggtggaaacggtgact

SEQ ID NO: 32433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctataactctgacacggcgattagttttccga

SEQ ID NO: 32434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctataagaggctttgatggactcggtttttgg

SEQ ID NO: 32435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctataatcaaaagaaaaggccaaatcagttcc

SEQ ID NO: 32436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctataatcgacctagtaaggttggcgtatgac

SEQ ID NO: 32437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctataattcgtcttagcacacactttgctatc

SEQ ID NO: 32438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatacagggaacgaggcattgggttgcgttg

SEQ ID NO: 32439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctataccgatctctagtcccccggaagacggc

SEQ ID NO: 32440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctataccgggccattccgtctagcagatatat

SEQ ID NO: 32441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctataccgttgcttatgtgtgcggggcacgtg

SEQ ID NO: 32442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatacgcacgcccctcactccggttgttgat

SEQ ID NO: 32443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatagaaccactgcgtcggagaggtccgggt

SEQ ID NO: 32444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatagactgggacgaggctttaccttacaga

SEQ ID NO: 32445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctataggaagggagtggtcagaactcgtgtac

SEQ ID NO: 32446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctataggcgacctcggatgtgttctctcgttc

SEQ ID NO: 32447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatagtcacctctcggatatcccgctgcaga

SEQ ID NO: 32448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatagtccccacacccaggttacctacgtgc

SEQ ID NO: 32449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatagttactgtcggcaaggcaagtccgcgg

SEQ ID NO: 32450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatagttgggtgttattagcttcttatttcc

SEQ ID NO: 32451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatagtttgacgcgtacggcgaattagttta

SEQ ID NO: 32452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatataatcgcactcgatctaatggaccttg

SEQ ID NO: 32453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatatatcaagtgtgtgggaacttctaatat

SEQ ID NO: 32454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatatattgggaaacttgctggctcggaaca

SEQ ID NO: 32455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatatcagtgtccccccggtctaaagcgtgt

SEQ ID NO: 32456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatatccaaggatcatagaacctgcccagac

SEQ ID NO: 32457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatatctatgttcttcacgacagtcccgggg

SEQ ID NO: 32458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatatctcgtctacactattcaatcaaggag

SEQ ID NO: 32459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatatcttggtactcctctttctatcgaatc

SEQ ID NO: 32460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatatggagttcgtcagaaagtatcctaagc

SEQ ID NO: 32461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatatggatgcatattcgaacagcttatgtc

SEQ ID NO: 32462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatatgtatctttaggtgctctgatggggtg

SEQ ID NO: 32463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatatgttggggcacaaggttgtgaagctgc

SEQ ID NO: 32464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatattcgtcaacagctgtgttataaatttc

SEQ ID NO: 32465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatattcttccgaaagggagtgtcacgcctc

SEQ ID NO: 32466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatattgaggtcggtcaacaatgttctcccg

SEQ ID NO: 32467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatatttgttcaaggtctgtgtatatgggga

SEQ ID NO: 32468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatatttttcccctattcccctggccggagg

SEQ ID NO: 32469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcaaacgtagcagtgctccagattgccgt

SEQ ID NO: 32470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcaacgggaagcttagcatagtgagcggc

SEQ ID NO: 32471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcaactgttagctgccaagcatggttgtc

SEQ ID NO: 32472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcaatagagtcgctttctatggtttagcg

SEQ ID NO: 32473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcacgttttcacgtcaggtattgttggca

SEQ ID NO: 32474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcagacagcaatgcataccgaagagttcc

SEQ ID NO: 32475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcattgtcctgcggtcgtgcaatgtttgg

SEQ ID NO: 32476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatccagtttcgcggacgtttatatgcgagc

SEQ ID NO: 32477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcccagctatcagtgttattacaaaggga

SEQ ID NO: 32478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcccgaggttttaggccgtcgcgatgccg

SEQ ID NO: 32479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcccgctgtagttaggcacctgttccggg

SEQ ID NO: 32480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcccgtgatcgaaaccttagggacacagt

SEQ ID NO: 32481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatccgcgccctagtccacatggtagtgtta

SEQ ID NO: 32482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatccgcggattttcttacatgtgagattgc

SEQ ID NO: 32483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatccggcaattctttctgcgggctgtcggg

SEQ ID NO: 32484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatccgtgtctgtcaccctcgagttctcccc

SEQ ID NO: 32485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcctcgactggtcgcgtgcagctgtgtgt

SEQ ID NO: 32486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcctgctctttacttccaacgttcaaagg

SEQ ID NO: 32487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcgaggtgtggtgcctgtgccgcgttgag

SEQ ID NO: 32488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcgagtgtccgctgattgctttccttgtt

SEQ ID NO: 32489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcgcgcggtgacaagatgggtgaggcgat

SEQ ID NO: 32490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcgctcagcctctttgtagatgcaagcgg

SEQ ID NO: 32491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcgctgcataagaagtcacaccgagtcct

SEQ ID NO: 32492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcgctgggcccgttctcccagatctttgc

SEQ ID NO: 32493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcggcagtatcagggagggaggcgactcg

SEQ ID NO: 32494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcgggctcctggaactccgagtttttgct

SEQ ID NO: 32495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcggtccgctacgaggattcgccaggcca

SEQ ID NO: 32496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcggtgcgtagcggtgtatattttcgggt

SEQ ID NO: 32497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcgtaaggcgacaacgaagctgctggtga

SEQ ID NO: 32498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcgtcctaacctagggtagagatatgtcc

SEQ ID NO: 32499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcgtggttatgtaatgtttaatccggtaa

SEQ ID NO: 32500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcgttgaaacgcgtactagatgcattgat

SEQ ID NO: 32501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatctagggcttgaagggaagtggggcctgc

SEQ ID NO: 32502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatctatgtacccgagttcattttgaagcgg

SEQ ID NO: 32503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatctcatttaaatcaggaaagaattatgcc

SEQ ID NO: 32504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatctcctgagaatcacaacatgtggacgcc

SEQ ID NO: 32505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatctcgcgcagcacaaactgacctgtcaac

SEQ ID NO: 32506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatctctcgcatgtgcgctacttcgactttg

SEQ ID NO: 32507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatctggtcaggggtctttgtacttaggggg

SEQ ID NO: 32508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatctggtggttcgttacgttggtctacggg

SEQ ID NO: 32509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcttcaggaactgtagatcggacacgttc

SEQ ID NO: 32510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatcttgataatatagctctccagacccgtt

SEQ ID NO: 32511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatctttggataacgggttttggatgcggcg

SEQ ID NO: 32512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgaactaggtaacccgcccgtttcgatca

SEQ ID NO: 32513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgaagtcgcggagtagggtaaggggctgt

SEQ ID NO: 32514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgacagaatccacttcatgtctactcgtt

SEQ ID NO: 32515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgacggatcggatcagggatcatctgcga

SEQ ID NO: 32516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgactacgttgtttcgattctggggcggt

SEQ ID NO: 32517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgaggttggttccctttgtggggaaagtt

SEQ ID NO: 32518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgagtcggccttaagtcgtccctgcgtag

SEQ ID NO: 32519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgatcgaaaagatgcaccccgttgagtgt

SEQ ID NO: 32520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgatggcgcggactcttgtgctcgacggt

SEQ ID NO: 32521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgatggtaacaaactgcggcgggacgatt

SEQ ID NO: 32522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgatggtcgtacgtctgcctcggaggagt

SEQ ID NO: 32523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgattcccgcatatatggtcgattgtgga

SEQ ID NO: 32524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgcaatgccatcgcatgtgggttgtgacg

SEQ ID NO: 32525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgcaattttggcttcttgcgagctggggc

SEQ ID NO: 32526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgcagctcggagctgagcttcttccggga

SEQ ID NO: 32527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgcattcattttgcctttcgtgttctccg

SEQ ID NO: 32528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgcccagcgtagaagaatgattgccattg

SEQ ID NO: 32529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgcgagtgccatcgtggagtttggacggc

SEQ ID NO: 32530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgcgatggttgtattatagttgtagtgtg

SEQ ID NO: 32531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgcgcgaaggtcgcccgtcaaatccagcc

SEQ ID NO: 32532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgcgcgattccaggcgtgtagatgcgtgt

SEQ ID NO: 32533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgcgtgatgtggatcagaaccagctcgtc

SEQ ID NO: 32534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgcgtggcttgcgtctctcgtgtcccgga

SEQ ID NO: 32535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgctccaggtttacagcataattgccaac

SEQ ID NO: 32536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgctctgtcgcttatgtcccgcgcctgcg

SEQ ID NO: 32537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgctgcgaaaccctgtggtttgcccttga

SEQ ID NO: 32538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgctggtcctctgctggggactccgattg

SEQ ID NO: 32539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgctgtacagacaaggcatcacccgcgac

SEQ ID NO: 32540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatggaccgagtgcttattttcacaaggctg

SEQ ID NO: 32541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatggagcttttctcgacactcttatttcgg

SEQ ID NO: 32542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatggcagggtcgagcatgcgctcctgccgt

SEQ ID NO: 32543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatggcagtccgcgcccaggtccccttacac

SEQ ID NO: 32544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatggccaaccgggcggggtctgtgtttagc

SEQ ID NO: 32545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatggcctcaccgaatatcagtgactcaggc

SEQ ID NO: 32546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatggcgatctcaaaacatcgctgcgctcgg

SEQ ID NO: 32547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatggctgggtctgcgtcacgtcatcagacc

SEQ ID NO: 32548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgggcaacccctcgcgtatgagtggttgt

SEQ ID NO: 32549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgggcggcattcaacactaccgtaaccga

SEQ ID NO: 32550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgggttattacgtaatcgcgtacgcaaga

SEQ ID NO: 32551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgggtttgtgtgtattagcccggttaaca

SEQ ID NO: 32552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatggtgactgtgtcgttaaagggaggtaca

SEQ ID NO: 32553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatggtgtggttacgcctagttgtgactact

SEQ ID NO: 32554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgtacgggcctggcatttcgagttcaatg

SEQ ID NO: 32555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgtatccggaagcgggggtactttttgtg

SEQ ID NO: 32556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgtattgccgaccgacgagagttatcgga

SEQ ID NO: 32557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgtccgccgtgattatattacagaaggac

SEQ ID NO: 32558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgtcctcaggtgctccaatacaggattgc

SEQ ID NO: 32559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgtcttacttatcgactggctgacgcact

SEQ ID NO: 32560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgtgatgggaccagatggtcagcgcatgg

SEQ ID NO: 32561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgtgcgtgcccttcacttgttcgggtacg

SEQ ID NO: 32562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgtgcttctcgtaatgatcgttcttgact

SEQ ID NO: 32563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgtgtccggccgtcagtgacgccttatgt

SEQ ID NO: 32564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgttaaagccctctgaggctaattggcat

SEQ ID NO: 32565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgttgtaatctacctgcatcaatacttga

SEQ ID NO: 32566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatgttttgggcgtgttccggctgcgatagt

SEQ ID NO: 32567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattaaatggttatgtgtattcacttcacat

SEQ ID NO: 32568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattacatcgttactgtcggtggcttctcgg

SEQ ID NO: 32569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattacgcacttcagatcgtggcagttcacg

SEQ ID NO: 32570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattagagtctcattctctgatattgtatgc

SEQ ID NO: 32571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattagtttctaccagcgatgtaatataacg

SEQ ID NO: 32572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattatctctgcagcttgaactggtggctag

SEQ ID NO: 32573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattattatgttcattttgcctctgctacgg

SEQ ID NO: 32574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattattcaggcagagtgatcggctgcattg

SEQ ID NO: 32575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattcaccctagtggcattatgaggttgata

SEQ ID NO: 32576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattccaagtatcgccaaaacctgggggttc

SEQ ID NO: 32577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattcccagtcggcggtctcgcttatgcgtt

SEQ ID NO: 32578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattcccctaatggccctgacccctcgctcg

SEQ ID NO: 32579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattccgctttcgctgaataatgtgctggcg

SEQ ID NO: 32580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattccggtatgtggttatgagtacactagt

SEQ ID NO: 32581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattcctagctgtatcgactgtggctggtac

SEQ ID NO: 32582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattcgactggaaacgtaactttaaatgagt

SEQ ID NO: 32583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattcgctggatttcggccggtcatgctttc

SEQ ID NO: 32584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattgaaaacgagtctgcatcgaatgcacgc

SEQ ID NO: 32585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattgaagttcctttgttttttcattgacgt

SEQ ID NO: 32586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattgatatggttcctgttcaaagttgttct

SEQ ID NO: 32587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattgatctttggggcaccagcccatacgtc

SEQ ID NO: 32588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattgcaaatcgacgcgtagtcaaggaatgg

SEQ ID NO: 32589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattgcaacggtgcatctatcttaaacttat

SEQ ID NO: 32590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattgcagcggtagaaactgtacgcgtgctg

SEQ ID NO: 32591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattgctctacgggagtcacctcctcctata

SEQ ID NO: 32592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattgctctctgtgctgtcccgcgctaactg

SEQ ID NO: 32593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattggacagtgggtatgatgccttcagtcc

SEQ ID NO: 32594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattggagggccgcgacttaactaccatcgg

SEQ ID NO: 32595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattggggcgtgtgggcatgtatgcgtagtg

SEQ ID NO: 32596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattggtacccagcccacgcgaacctccgtc

SEQ ID NO: 32597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattggtagtctcccgccgcctcgcattttg

SEQ ID NO: 32598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattggtctccacgtgacatgagcagttttc

SEQ ID NO: 32599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattgtccgcgggcggatgagatttttccgg

SEQ ID NO: 32600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattgtccgctgctgtggttgtgcactcttt

SEQ ID NO: 32601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattgtctaattaagttattttccttcgatg

SEQ ID NO: 32602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattgtgctcgtaccgccagtattgcgcgcc

SEQ ID NO: 32603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattgttgctactacagtggccccgtgaccc

SEQ ID NO: 32604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatttagaacaaagacttgttaggcatgggc

SEQ ID NO: 32605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatttagaggtgaatctaccctaattaacat

SEQ ID NO: 32606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatttcggaggatgggggtttctgtgactta

SEQ ID NO: 32607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatttgaggagcgctgtattccacgctcaga

SEQ ID NO: 32608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatttgatgcaatcggagggcttcacgtaag

SEQ ID NO: 32609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatttggaagcaggatgctcgcggcgcaacg

SEQ ID NO: 32610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctatttggggaactatactacccctgttgatt

SEQ ID NO: 32611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattttaatacactttcttcaaatcctcgcc

SEQ ID NO: 32612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattttacgcttctagaggcgttgtcgtttc

SEQ ID NO: 32613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctattttccctcgtatattgtgacgaactgtt

SEQ ID NO: 32614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaaacgggccgttcaggattaggattatc

SEQ ID NO: 32615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaaatggtatctcctggtgagtatcgcct

SEQ ID NO: 32616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaacctcggttagccaggtattgcctctt

SEQ ID NO: 32617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaacggacgagccggtgagttgatgaagg

SEQ ID NO: 32618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaacggagctcgttcggctagtttctgtc

SEQ ID NO: 32619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaacggattgcgagttcgtacacgtaagt

SEQ ID NO: 32620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaacgttgcgttatattgacgctgtacgt

SEQ ID NO: 32621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaaggatctcgtgtggaagagaggcttct

SEQ ID NO: 32622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaatactttgggatgaatgcggtatctac

SEQ ID NO: 32623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaatcagtggtctgacggtgtctcaggac

SEQ ID NO: 32624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaatctaggaggcgtctacaattgtgccc

SEQ ID NO: 32625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaatgtcgtaggccggttgtttgcgcaag

SEQ ID NO: 32626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaatgtgctcaacccatatgcctgtccac

SEQ ID NO: 32627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaattcggcttcccagacacgtctattaa

SEQ ID NO: 32628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaacaatggcttttgctccacgtacgtcga

SEQ ID NO: 32629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaacacgcttccactattcacttgcggtac

SEQ ID NO: 32630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaacacgtccataccatggcaggccgattt

SEQ ID NO: 32631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaacagccggatgccacatttcctgggcgg

SEQ ID NO: 32632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaacagcgtcaccagtttccttgttatcgt

SEQ ID NO: 32633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaacaggggagtatacatgacctgctgacg

SEQ ID NO: 32634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaacatcggtgtaactggctggcctccccg

SEQ ID NO: 32635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaacatctgcgatggtttactacgatcatg

SEQ ID NO: 32636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaacatgcgcgagatgatggtctgcactct

SEQ ID NO: 32637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaacatttgctctggaatccgtgggacgtt

SEQ ID NO: 32638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaccagcatcgaaagctaactgaaaaggc

SEQ ID NO: 32639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaacctttccgtcctcgatcagctttggtg

SEQ ID NO: 32640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaacgcaatctggtcactttgagattacgt

SEQ ID NO: 32641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaacggaatggcggtctctccgataacgtg

SEQ ID NO: 32642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaacgggaagccattaggtctctagatcac

SEQ ID NO: 32643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaacgttcctgagcacgcttagttgatttg

SEQ ID NO: 32644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaactgccttacagtatgccacaaccattt

SEQ ID NO: 32645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaactgggagcgcaagtgcgtatttgcaaa

SEQ ID NO: 32646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaagaaccacgcagcgcgatctgggtgcgg

SEQ ID NO: 32647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaagaacgcagggcgtgtgccggtcaacgc

SEQ ID NO: 32648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaagaacgcttgaggtttcggtctgtcgct

SEQ ID NO: 32649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaagacgagcacgcagtttcccggcccatg

SEQ ID NO: 32650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaagactcttgtccgcttaaggtccactgt

SEQ ID NO: 32651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaagccggctttgcactatttgagtagtgg

SEQ ID NO: 32652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaagcgaccgtgtaactttgaggggtccgt

SEQ ID NO: 32653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaagcgcgtcagtgtattattagctcacgt

SEQ ID NO: 32654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaagcggatgttgatggcaccattttggcg

SEQ ID NO: 32655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaagcttcgtaatttgatttctaccgatca

SEQ ID NO: 32656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaggcaataggttatcgtccgtctcgttt

SEQ ID NO: 32657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaggcacaaatgcccttacgacagggtag

SEQ ID NO: 32658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaggcagcgtgctatctagtgctagcgga

SEQ ID NO: 32659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaaggctccggacccgagcgatctgagcgg

SEQ ID NO: 32660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaagtaaagttcgactatgccggtagcctt

SEQ ID NO: 32661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaagtataaaagagtcttcgggttctaagc

SEQ ID NO: 32662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaagtctggttccgtcggggtgagtcggga

SEQ ID NO: 32663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaagtggttacattgacggcctcaagtatt

SEQ ID NO: 32664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaagttatgcctagcacgaagtagcgtctc

SEQ ID NO: 32665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaagttggccagggggagctgctgttctcg

SEQ ID NO: 32666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaataattaggagagagaggtcttctggcg

SEQ ID NO: 32667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatacggacgtcggcagtccattctaagg

SEQ ID NO: 32668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatacgtctagtttcttgataaccaggtt

SEQ ID NO: 32669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatactgcgtttgatgcctgcgttcggcg

SEQ ID NO: 32670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatagctgaggcctgatctcaccatcatt

SEQ ID NO: 32671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaataggccgcttttctcgaacccacgggg

SEQ ID NO: 32672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatcagtacgagcttccttagggtccaca

SEQ ID NO: 32673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatccatttgggaattaggaacttgacga

SEQ ID NO: 32674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatccgccccggaagaacagcacggttac

SEQ ID NO: 32675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatgacatctggcttcagggcacacattg

SEQ ID NO: 32676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatgagcaccgaaaatagatttgaaactc

SEQ ID NO: 32677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatgcacaaagtaatactgggacggggag

SEQ ID NO: 32678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatgcagtattttgcccgcttgtatcgac

SEQ ID NO: 32679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatgcgggttcgagtaatgagtcatcttg

SEQ ID NO: 32680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatgcgtgacctggtgaagacactatgcc

SEQ ID NO: 32681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatggcgcatgtcgtacgctggacccatg

SEQ ID NO: 32682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatgggggagcaggacacagtgatatcgg

SEQ ID NO: 32683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatggttttctcggggatagaagtgtttc

SEQ ID NO: 32684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatgtccagggattttaatgacgttcatc

SEQ ID NO: 32685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatgttggtagctgggggtttatctcgta

SEQ ID NO: 32686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaatgttgtgggaccgctgtttgatgtgta

SEQ ID NO: 32687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaattccggcggagccgcagtttggtagtg

SEQ ID NO: 32688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacaagcgagtcgggttcggactgtactgt

SEQ ID NO: 32689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacaaggcctagtacgcgtgagttgcttac

SEQ ID NO: 32690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacaatctcgaatccggaccggcctgactg

SEQ ID NO: 32691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacacatgggcgcgctgtacgtggcccagt

SEQ ID NO: 32692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacaccaacagactcagctttccggagctt

SEQ ID NO: 32693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacacgggtagacctctcgtacggccgctt

SEQ ID NO: 32694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacacgtctatgtctcctgatttcgagtgg

SEQ ID NO: 32695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacacgttgctgtgtcggttactaaggctc

SEQ ID NO: 32696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacactgtggtggcttcagataggctggat

SEQ ID NO: 32697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacaggcatgcgatgagcactaataacccc

SEQ ID NO: 32698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacagtagcagccccgcatgcgattttggg

SEQ ID NO: 32699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacataatcctcgaaccctcacttgtggac

SEQ ID NO: 32700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacatacccgcgtacgggacttctgtgaat

SEQ ID NO: 32701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacatcaagaggtcagctccgtacacacca

SEQ ID NO: 32702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacatcccacccggcgcgcagactgccatc

SEQ ID NO: 32703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacatccccacgatcaccacgaggggaacc

SEQ ID NO: 32704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacatgcgtagcgggaaccccagactacca

SEQ ID NO: 32705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacatgggagccggctggatctcgcggagc

SEQ ID NO: 32706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaccatcatcaaaggtcggtcatctatacc

SEQ ID NO: 32707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaccatccacagcaacatcgggcacttagc

SEQ ID NO: 32708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaccattatgattagtgcgctggccccttc

SEQ ID NO: 32709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacccaccaagaagatcctcgtccgtcgcg

SEQ ID NO: 32710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacccacgacatcggcaaacgctgcatgat

SEQ ID NO: 32711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacccactcgcttcgaagcaatttcagatc

SEQ ID NO: 32712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacccagagtcaactgcatccgatatacac

SEQ ID NO: 32713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacccagtgcggccggagtcgttgctataa

SEQ ID NO: 32714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacccctcagtgtacttacattcccaattt

SEQ ID NO: 32715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacccctctgaagcttttgctggtagtcgc

SEQ ID NO: 32716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacccggcagcccttggagctgaaggagag

SEQ ID NO: 32717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacccgtgccagaattcttccgtggcgttc

SEQ ID NO: 32718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacccttacttctgtgaggaattcagagtt

SEQ ID NO: 32719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaccgcaacggcaacggagggtggaggcac

SEQ ID NO: 32720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaccgcatttgttggggctgaagttggtgc

SEQ ID NO: 32721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaccgcgagtaagggagagtgtgtccctac

SEQ ID NO: 32722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaccgcgtgtccattgtacatgtcgtggtc

SEQ ID NO: 32723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaccggaagggatgacacttggatagggcg

SEQ ID NO: 32724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaccggtaacggttctatcttccgtgtcgg

SEQ ID NO: 32725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaccggtttccaatgaagcggtttcttgtg

SEQ ID NO: 32726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacctcctagggtcgtagtgggcgttcccc

SEQ ID NO: 32727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacctgcaagaaggatgaacggacgctcgc

SEQ ID NO: 32728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacctggggttgacaacgcgtttggcacct

SEQ ID NO: 32729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaccttctccaattagcggaataaatagga

SEQ ID NO: 32730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgaaaggctatctgctggcgccacagat

SEQ ID NO: 32731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgagaacaacgggatcgacgctcggacc

SEQ ID NO: 32732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgaggcccgggaacgtatgggatggctc

SEQ ID NO: 32733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgatgatatgagtgaagttgagaggaag

SEQ ID NO: 32734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgcatgtgcgaaaacggccaatccctcg

SEQ ID NO: 32735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgcgggaacagtcgtggtgtgcaccatt

SEQ ID NO: 32736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgcgtacaaggtgtactacgtgttcttc

SEQ ID NO: 32737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgcgtacttatggttcggtttatgtttt

SEQ ID NO: 32738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgcgtcgagcacgtatctttttagtcgt

SEQ ID NO: 32739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgctctactttctatttcaatcccctga

SEQ ID NO: 32740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgctgccgcacacgatccgaggtacgcg

SEQ ID NO: 32741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacggaacggccaggtgttgcacggtgtgg

SEQ ID NO: 32742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacggaggatcactaaactcagtgtacaac

SEQ ID NO: 32743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacggaggtcacgtctaggttccagcagag

SEQ ID NO: 32744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacggagtcagggaatagctggtggttata

SEQ ID NO: 32745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacggctgtaacgtcacgcgttcatactgg

SEQ ID NO: 32746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgggacgggttgcacgaggtagtacggt

SEQ ID NO: 32747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacggtagacttgctgttgattgggtttcg

SEQ ID NO: 32748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgtacggctgaatgggtgggaccatcgg

SEQ ID NO: 32749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgtatctcatcttcggttcaaagccctc

SEQ ID NO: 32750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgtcgtatacttacgtggctcaccggcc

SEQ ID NO: 32751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgtctgcatcacgaacgggggtcctcgg

SEQ ID NO: 32752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgtcttgtcatgataccttcgtaaattg

SEQ ID NO: 32753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgtgccgtggtccccatcttacaagatt

SEQ ID NO: 32754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacgtttgattgctaccaaggtgttaccgt

SEQ ID NO: 32755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcactaattcgggggtggtcggtcagctctg

SEQ ID NO: 32756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcactaggcgtgcgtctgattgatctgctgt

SEQ ID NO: 32757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcactcccggtggttcggtttacttgccctg

SEQ ID NO: 32758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcactcggaggacatacgtactttcgtgact

SEQ ID NO: 32759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcactctacgtcagggacaaggatggggtgg

SEQ ID NO: 32760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcactctccacacgcgttctagaccgtttcg

SEQ ID NO: 32761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcactctcgaatctgagatggattgcgtaac

SEQ ID NO: 32762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcactgacccccgcgcccgttggtagtcatt

SEQ ID NO: 32763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcactgcgcttattgaatcatttgagcgggt

SEQ ID NO: 32764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcactggaataagggcgtggatcgtaaacga

SEQ ID NO: 32765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcactggacacgtgaacgactcctaggggtg

SEQ ID NO: 32766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcactgtactgcacctacacaggctccttgg

SEQ ID NO: 32767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcactgtcgtctgatgtgtccgttacatgaa

SEQ ID NO: 32768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcactgtctgctgggcgtgcgcgcaacgatt

SEQ ID NO: 32769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcactgttacgcgggtactgcttacggcgcg

SEQ ID NO: 32770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacttactgcagtcccacggttgatgttta

SEQ ID NO: 32771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacttcaacgcactcgcttcgggctacgca

SEQ ID NO: 32772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacttcaatggcgttgagtgaacggtggag

SEQ ID NO: 32773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacttgccggtattgcttggaacattccga

SEQ ID NO: 32774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacttgcggtgccatcagaaacaacgtccc

SEQ ID NO: 32775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcacttgtacggcttggtaagcgcggagaac

SEQ ID NO: 32776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagaaatcccgccggaggcagttgtggctg

SEQ ID NO: 32777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagaacattttcgtcttatcgtgtccggga

SEQ ID NO: 32778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagacgcgttgaccgttccgtggatgtatt

SEQ ID NO: 32779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagacttccctgtattcgtcacacaatagc

SEQ ID NO: 32780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagacttttctcgtataacgactcggtata

SEQ ID NO: 32781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagagataatcgaactcaacgcacggcggt

SEQ ID NO: 32782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagagattccagatttgagttactacgagg

SEQ ID NO: 32783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagagcacgaattgttcagtcgacgcaata

SEQ ID NO: 32784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagagcctcatcggtctttgtcaagctcac

SEQ ID NO: 32785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagagcctgctgtccgacattctcccgtgc

SEQ ID NO: 32786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagagtaaaggataggattacgtttatttg

SEQ ID NO: 32787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagagtcgattgattaacacctgtgcacgg

SEQ ID NO: 32788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagatagccgactctgctggtttacaagtg

SEQ ID NO: 32789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagcacaacgggcttcttggatccgaactg

SEQ ID NO: 32790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagcacagggcctttcggtggatgatggtg

SEQ ID NO: 32791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagcacccggttcagagtatagtcaccgtc

SEQ ID NO: 32792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagcaccgggcacggccattacctgctgtc

SEQ ID NO: 32793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagcagagtatcgccatacagggatagagg

SEQ ID NO: 32794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagcatcataccgatatcaatcggactcta

SEQ ID NO: 32795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagcattatttgttgctctttagagaactc

SEQ ID NO: 32796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagccaagcgtcattatcgaagtgatgggc

SEQ ID NO: 32797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagccattttagatctgcatctcatctata

SEQ ID NO: 32798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagcccctattacgcgcacacggcgacctt

SEQ ID NO: 32799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagcccgagaaaaagtcgaccgggatcatg

SEQ ID NO: 32800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagccctcttatcataacggacatgtacac

SEQ ID NO: 32801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagccgattcccccgaagcaacgggatcgg

SEQ ID NO: 32802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagccgattgacaacgagacgcttaaagag

SEQ ID NO: 32803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagccggaagacggtgggtgttgggagttg

SEQ ID NO: 32804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagcgatattgttgttgcaagggtgccgac

SEQ ID NO: 32805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagcgcgatctccttggttctcgggggttg

SEQ ID NO: 32806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagcgggaacaacaggacgcagcaagatgg

SEQ ID NO: 32807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagcggggtttgccggtgcatcgatatttg

SEQ ID NO: 32808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagctcaagtctgctttaggtacgaaggcg

SEQ ID NO: 32809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagctccaggcaggcatgcgtaactatctc

SEQ ID NO: 32810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagctctcccgcattcgtgtaaggggcaga

SEQ ID NO: 32811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagctgcttcatacgattgaaactcccgcc

SEQ ID NO: 32812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagctttgaagctttcgttgtgtgcaagcg

SEQ ID NO: 32813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggacagtacgttcgggtggtgatccggt

SEQ ID NO: 32814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggagggtgttgctaccgacgagggtctg

SEQ ID NO: 32815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggataggctcatattcaccggacgcttc

SEQ ID NO: 32816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggatcgcagccagcccgggaccccatgg

SEQ ID NO: 32817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggatgctcgaggaaagggcgaggccatt

SEQ ID NO: 32818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggattttagggtcttaacgtatcggctg

SEQ ID NO: 32819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggcactagatgatacgcgtatactttcg

SEQ ID NO: 32820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggccctttatcagatggttagccagtcg

SEQ ID NO: 32821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggcctgtggggttttaccatgacatagg

SEQ ID NO: 32822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggcgcaggtcgggtatggacgtgttgac

SEQ ID NO: 32823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggctattggaagttttcaagctacgtta

SEQ ID NO: 32824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggctcctggttccgactcaaatttggtt

SEQ ID NO: 32825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggcttacttccgcggcctggaacagatt

SEQ ID NO: 32826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagggaaacttcatggtgggttattcctat

SEQ ID NO: 32827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagggaccccaaacgtcaagcagacgacaa

SEQ ID NO: 32828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagggcatgacagagtcgctgtggcattgc

SEQ ID NO: 32829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagggcatggcggcagtctctcgtcgtttg

SEQ ID NO: 32830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagggcgcggagattctgtgctgtcgtctg

SEQ ID NO: 32831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagggctggcggttgtgtagagttgcgggg

SEQ ID NO: 32832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggggcagtaattcttacaccagctagtc

SEQ ID NO: 32833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagggtaccaggcaagtgggtcacgcgttg

SEQ ID NO: 32834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagggtgagatcaatgagtacctagctatc

SEQ ID NO: 32835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggtaacccatttccgccaacgcttaggg

SEQ ID NO: 32836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggtatgtattgatgttttacgttctgtc

SEQ ID NO: 32837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggtcatagtaaaccgccgtcttttgccg

SEQ ID NO: 32838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggtcattgcttgtgggtcgtgtgtaggg

SEQ ID NO: 32839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggtcccgagaaccaggagctggtacagt

SEQ ID NO: 32840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggtgccttttatgacttagcggaatcat

SEQ ID NO: 32841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggtgtaagcttcagtttaccgacaagtc

SEQ ID NO: 32842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggttgccattcggctaaaagttggaaac

SEQ ID NO: 32843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcaggtttaccagcatccgagttatcaagtt

SEQ ID NO: 32844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagtaccccatagggcaagggaacacgcca

SEQ ID NO: 32845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagtacgtagggcggacaatcacgagccga

SEQ ID NO: 32846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagtacttgttggatctggcggtacgttgc

SEQ ID NO: 32847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagtaggctgggttagcgattccgattatg

SEQ ID NO: 32848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagtcaccacgttatagtcggtatttgcct

SEQ ID NO: 32849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagtccacgggttgagcaacccatagccgg

SEQ ID NO: 32850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagtctcccgcttaatgtgacctttcgcaa

SEQ ID NO: 32851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagtgcggcgggggcttcaaagacgtgacg

SEQ ID NO: 32852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagtgcttctccctcatgtgtagtggttgc

SEQ ID NO: 32853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagtgtcacactgtccacggcccttcaaca

SEQ ID NO: 32854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagtgtcctcgttcgcgtgctctcaacggc

SEQ ID NO: 32855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagtgtgcggaccatgcctgcttctagctt

SEQ ID NO: 32856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagtgtgcttactgatgtggggcagtcagc

SEQ ID NO: 32857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagtgtttgacaacttttttccatatcggc

SEQ ID NO: 32858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagttaaggccatatcctgggttagcgcct

SEQ ID NO: 32859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagttacccgacctgcaagcccgacatgtc

SEQ ID NO: 32860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagttactcatcacgcagaattacctcgag

SEQ ID NO: 32861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagttagggtcaagctaatccgatacacct

SEQ ID NO: 32862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagttccggtagacgaggttaggtcctcgt

SEQ ID NO: 32863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagttcctacccacggccacggaaagattg

SEQ ID NO: 32864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcagtttgtggtctgtgatcccgtcttgcgg

SEQ ID NO: 32865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcataaatacctgagcaaggaccagtaggaa

SEQ ID NO: 32866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcataagtgctcagtaaatagactagatctt

SEQ ID NO: 32867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatacaccttcgtctggataccgctggtct

SEQ ID NO: 32868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatacccacaggggaaagatggagcgttgg

SEQ ID NO: 32869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcataccgttcatggtccttacgacatagcg

SEQ ID NO: 32870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatacggtccatccgcctccgacctcagcc

SEQ ID NO: 32871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatacggttaatctgggttagagaaagacg

SEQ ID NO: 32872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatacgtgttgcgtacgggggtgtgatctg

SEQ ID NO: 32873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatactctatctcaatgttacggcccaggg

SEQ ID NO: 32874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatagcaccagtcacacgaggcggtatccg

SEQ ID NO: 32875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatagtgcgcacccttagttcgaccgggtg

SEQ ID NO: 32876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatatatgacgggaccacggattacccacc

SEQ ID NO: 32877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatcaaccgcacgtgcttattgctaggcac

SEQ ID NO: 32878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatcacacgatctttgctcgggcctttgta

SEQ ID NO: 32879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatcaccattatgggggccacgtcgggggt

SEQ ID NO: 32880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatcacgggggatctacgttactggcccgc

SEQ ID NO: 32881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatcatgcttttcattgctagcatgaggct

SEQ ID NO: 32882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatccaagggtgcgaggttatgtgaaggcc

SEQ ID NO: 32883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatccatatctgggggcgctcgttggtacg

SEQ ID NO: 32884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatcccgcggcgaaatcacaccggagacta

SEQ ID NO: 32885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatccgagaaagaattcacttctggtaccc

SEQ ID NO: 32886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatccgtgcatggggggtgacagccaaact

SEQ ID NO: 32887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatcctctcggcggagggggacaggccaga

SEQ ID NO: 32888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatcgacgtaaaagcaatgtctagaccgta

SEQ ID NO: 32889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatctaaatgccaaggatcatgttgattat

SEQ ID NO: 32890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatctctgtggaattttctctgcggcttaa

SEQ ID NO: 32891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatctgcgaaagggccggggttgtttgatt

SEQ ID NO: 32892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatctgctctgtccatcgcaggagtcgact

SEQ ID NO: 32893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatgacgctggttcttcgccaagaatttat

SEQ ID NO: 32894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatgagccaccgtctactccgcgttaccgc

SEQ ID NO: 32895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatgaggacgggccgggttgaacttgccgt

SEQ ID NO: 32896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatgatgttttccgcgtcgtcgagctgtca

SEQ ID NO: 32897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatgccccggccatgtttcttggatagcaa

SEQ ID NO: 32898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatgccggagatagcgtgagcaccatgtcc

SEQ ID NO: 32899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatgcgccttacgaagttaaattgaacgga

SEQ ID NO: 32900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatggacgggcgttattgaatgttcttttt

SEQ ID NO: 32901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatggagggctgttgtaggaggggcgtctg

SEQ ID NO: 32902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatggcaatacagaacgaccctggtggtgg

SEQ ID NO: 32903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatggctcggcccgggcaaaatacgcgatc

SEQ ID NO: 32904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatgggccccccatacaagttctgtgctaa

SEQ ID NO: 32905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatgggcgggaaagcgttcgaaatgttctc

SEQ ID NO: 32906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatgggctatcgaccagagtgacaggcatg

SEQ ID NO: 32907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatggggagtccacagtcggtggtgcgagg

SEQ ID NO: 32908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatggggcaccgggcttaataggtcctcgg

SEQ ID NO: 32909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatgggttggcaattctctgaggggtgggc

SEQ ID NO: 32910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatggtaatcgaactccgctacgccacggg

SEQ ID NO: 32911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatggtacatcaccggtttccggcacgtgc

SEQ ID NO: 32912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatggtggtggcagccggtgagtggcggta

SEQ ID NO: 32913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatgtaaatggaacttgcttcatattgagc

SEQ ID NO: 32914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatgtcaagaggactagggctacgctgtgt

SEQ ID NO: 32915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatgtgtgcaggatccggaggcgcttttcc

SEQ ID NO: 32916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatgtgtgttaggtcgcctctagacttgcg

SEQ ID NO: 32917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatgtttgatgtgagtggcgaggcgagttt

SEQ ID NO: 32918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatgtttggaggtgcaaatggcacgtagaa

SEQ ID NO: 32919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcattagcgtgctcatctgatcaggcgggag

SEQ ID NO: 32920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcattagtattacaggtgcttgaactcttga

SEQ ID NO: 32921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcattataattccgttagctttagaataaca

SEQ ID NO: 32922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcattatgtaattccgtgttagttggttggt

SEQ ID NO: 32923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcattattggccgtttagactcggtatgttc

SEQ ID NO: 32924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcattcattacgcgacgtgcgtacttttctc

SEQ ID NO: 32925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcattccgaggcctcttgacaaaggttgtag

SEQ ID NO: 32926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcattccttcatgctcggcggggtttgatcg

SEQ ID NO: 32927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcattcggacgtgtgccatgacacggtctcg

SEQ ID NO: 32928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcattcggctcccgcatcgtgcatgttctcc

SEQ ID NO: 32929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcattctcaagcggctcctttcccggaaggg

SEQ ID NO: 32930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcattgacagaggctcgtctcttgttgtcca

SEQ ID NO: 32931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatttagtagtcggggcaagcgcgtaccgg

SEQ ID NO: 32932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatttagttatctcgcctatcgtttcgtgc

SEQ ID NO: 32933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcatttgggtaggtcgatgaaagacgagacc

SEQ ID NO: 32934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcattttgcgtaggagcagggagcattaacc

SEQ ID NO: 32935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaaagtgtttttctgggtgcgtttccctg

SEQ ID NO: 32936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaaatctggcaggtgcacgggtaaggggc

SEQ ID NO: 32937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaacgagtggcggagtggaggtcgtaggg

SEQ ID NO: 32938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaacgatactgcttaaacgagcgcaccga

SEQ ID NO: 32939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaactagataatacctgttattttggggg

SEQ ID NO: 32940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaactcgagtcgatttatgccctcgctac

SEQ ID NO: 32941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaagaacctaaagtgctttcccgcgcgct

SEQ ID NO: 32942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaagaacgacaccagaggtagtggcggtg

SEQ ID NO: 32943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaagacgtctatcttttgctgcgcgttag

SEQ ID NO: 32944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaagagcctgctacgggaatatgcgggta

SEQ ID NO: 32945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaagctctgtggcgttgttattctgtgcg

SEQ ID NO: 32946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaagtagtcctccgtatgtgcttgcgcta

SEQ ID NO: 32947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaatcggaatcctccctgggttgtcgccg

SEQ ID NO: 32948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaattctacccgtgatctagctggtgatt

SEQ ID NO: 32949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaattgttttgtttattttgtcttggcct

SEQ ID NO: 32950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacacatcgaaccgaccatatttcgacct

SEQ ID NO: 32951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacagcgggccaagttctgcgttcctcga

SEQ ID NO: 32952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacaggtgctgctttgaagcccttgtgcc

SEQ ID NO: 32953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacatgctacagtcctgccgagggggcct

SEQ ID NO: 32954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacattccgttatcacgcctgcaagcggg

SEQ ID NO: 32955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaccgccacacaaatctgttctttgggcc

SEQ ID NO: 32956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaccgtgcttctgagcggctatatgcgag

SEQ ID NO: 32957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacctgaccagggtttttcttcgggtcgc

SEQ ID NO: 32958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacgaaacctgctgtgcattcgctccttg

SEQ ID NO: 32959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacgaagcagggtattaagactctgctca

SEQ ID NO: 32960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacgaccagcgaagtttcaaggtggcttt

SEQ ID NO: 32961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacgagatgcgtttgcagtgtggtagtgc

SEQ ID NO: 32962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacgcactctcgcatttctgccgccttct

SEQ ID NO: 32963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacgcccaggttcgtgttgaggtaagagg

SEQ ID NO: 32964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacgcgtagggcttggctagctggttgga

SEQ ID NO: 32965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacggacgggtatacatttggagtgtcga

SEQ ID NO: 32966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacgggatgtggactacgcctctgaacgg

SEQ ID NO: 32967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacgggtgtcatgcctgcgggacggtagc

SEQ ID NO: 32968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacggtatgtcgacgcccgacggctacat

SEQ ID NO: 32969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccactaaggctcagtaggacagtccaagtt

SEQ ID NO: 32970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccactacactctcttgtaaatgtttttgtt

SEQ ID NO: 32971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccactacgatcacatttaccaatgttaacg

SEQ ID NO: 32972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccactagggggagtagatcggtaagtgatc

SEQ ID NO: 32973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccactcacgtgttgtcaagccctgggcggg

SEQ ID NO: 32974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccactcctgagacagaggagcagccgtcaa

SEQ ID NO: 32975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccactctctctgtcgtcagttttgagccgc

SEQ ID NO: 32976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccactgtataagccgatgaattgatagccg

SEQ ID NO: 32977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacttgatacatgttcaatcacgattttg

SEQ ID NO: 32978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccacttgtttcaccctttggacgcggctcg

SEQ ID NO: 32979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccactttgtatgggctgactaggaactagg

SEQ ID NO: 32980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccagagacccaacacgaacaggcgatggcc

SEQ ID NO: 32981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccagatagtatgaggtgggcgagagagacg

SEQ ID NO: 32982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccagcttaaccccgttcgacggttttgcct

SEQ ID NO: 32983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccagctttatggcatcctcgcacttttggg

SEQ ID NO: 32984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaggaactgctgtgtgcaagcacctgatc

SEQ ID NO: 32985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaggatgtctcactcctgtgtggtgggtg

SEQ ID NO: 32986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaggcccccagtcgatgcaagcctccaag

SEQ ID NO: 32987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccagggcggtcactagaaagagcgttgtcg

SEQ ID NO: 32988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccaggtctcttgataaaaaggttaccgggt

SEQ ID NO: 32989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccagtaacgatcacatgcatccggatgttt

SEQ ID NO: 32990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccagtattgtactcccaaaccagtaagcga

SEQ ID NO: 32991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccagtgcgcacatgcgttttattagacggg

SEQ ID NO: 32992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccagttctaggtagggaaggtgtccatcct

SEQ ID NO: 32993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccagttttggttacgacggtcagtttcatt

SEQ ID NO: 32994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccataacctcacatttgagccgaaccccgg

SEQ ID NO: 32995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccataccgcagttattcattatttccagag

SEQ ID NO: 32996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatacgttggggcatggcagtgtttggcc

SEQ ID NO: 32997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatagttgtgtgtcagccacgtcctccca

SEQ ID NO: 32998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatatcggaacaaatgtggcggaaacgtg

SEQ ID NO: 32999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatatctcggacaagctacaaatctcaga

SEQ ID NO: 33000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatcattcgctctacctccggacctaagc

SEQ ID NO: 33001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatcctacacacttttaggtctacctatt

SEQ ID NO: 33002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatcggccggatttgatcttgtggctaag

SEQ ID NO: 33003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatcgtacggcaggatcatgaatagggca

SEQ ID NO: 33004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatcgtctttgaagctggccgtgaatttt

SEQ ID NO: 33005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatcgtgtcaaatgttgcatgcacgccct

SEQ ID NO: 33006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatcgtttagcggcgattgggaatgcagt

SEQ ID NO: 33007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatctgtcttctcatcacacatcgtatct

SEQ ID NO: 33008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatcttggctccgagcgatctgttaggca

SEQ ID NO: 33009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatcttttcggatggccaagaagagtgtg

SEQ ID NO: 33010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatgcgaatgaatcgtcttcactctatat

SEQ ID NO: 33011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatggaaggaggacgttttgagacttagc

SEQ ID NO: 33012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatggatacgtacaagatttcagactcat

SEQ ID NO: 33013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatggtcggcgagttacaatgcaccttgc

SEQ ID NO: 33014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatgtaaaggggatagcgttgttgtattg

SEQ ID NO: 33015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatgtatatttagcagcatctcggacggc

SEQ ID NO: 33016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatgttcggtaaattagccacagacgggt

SEQ ID NO: 33017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccatgttgctcctataatggtgctgttacg

SEQ ID NO: 33018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccattagtagatcagcggacgcttgaccac

SEQ ID NO: 33019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccattgtaagacgaccacgtagtaagtggg

SEQ ID NO: 33020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccaaactccgtcttcaggcgcattaacgc

SEQ ID NO: 33021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccaacctgttgcctgaggtatgctccgtg

SEQ ID NO: 33022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccaatgtacgatagcgttgtatcaagcgt

SEQ ID NO: 33023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccacacataccgttgatcacttcacggtt

SEQ ID NO: 33024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccacaccttttcggaatgggaaggtgaca

SEQ ID NO: 33025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccagccgacatacctggacggctccgtgt

SEQ ID NO: 33026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccaggcactctgttactcatcgcgctctt

SEQ ID NO: 33027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccaggtattttccttacaggccgccgctg

SEQ ID NO: 33028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccagtaactccggcagggttctttcgccc

SEQ ID NO: 33029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccagttatgcgatctaaaatcttacgtca

SEQ ID NO: 33030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccagttcagaactcgaattgctggctaat

SEQ ID NO: 33031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccagttcaggatgttattcagcgctgtcg

SEQ ID NO: 33032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccatccaggccgaaggtcgcgccgcgcta

SEQ ID NO: 33033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccatgtcacggtccgcggccttcaattgt

SEQ ID NO: 33034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccatgtgcgcatcagtgctttacccattg

SEQ ID NO: 33035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccatgtgtataaggtacaaatacaccgct

SEQ ID NO: 33036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccatgttccgcctcctcctgtataccgtc

SEQ ID NO: 33037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccattaacactcggctaattacagtgctg

SEQ ID NO: 33038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccccaaatcacagcgccttatgaccatggg

SEQ ID NO: 33039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccccacaccagacattgtgattttcgggtt

SEQ ID NO: 33040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccccacgggcagtccaagccgcgctgcatg

SEQ ID NO: 33041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccccagaatctgatcttcagtggggtccaa

SEQ ID NO: 33042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccccagctaattattccggcttgctcctga

SEQ ID NO: 33043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccccatgtccgcttgatcttttacatcgt

SEQ ID NO: 33044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccccctggctcgcgcgttagtggcttcgt

SEQ ID NO: 33045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccccctggcaaagcgggcttgctttcctgt

SEQ ID NO: 33046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccccgactctaccggcgcacttctacgctg

SEQ ID NO: 33047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccccgatatttatatgcagttccgatgcgc

SEQ ID NO: 33048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccccgcgcgccgtcttgcagtgaatgggcg

SEQ ID NO: 33049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccccgctcaaccaatttgtcctggatccgc

SEQ ID NO: 33050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccccgctcctctcatcctagttgtctgggg

SEQ ID NO: 33051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccccggaagtctactgttttccggcaactg

SEQ ID NO: 33052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccccgggtccacaagggcggtgtctggtac

SEQ ID NO: 33053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccccgtgaatctttccttcttcggcctcgt

SEQ ID NO: 33054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccccgtgggacatttctaatagccagtgag

SEQ ID NO: 33055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccctcgtctgatcaggtgtgcgatctatg

SEQ ID NO: 33056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccctgatttgccgcaaggtccgtgaacgt

SEQ ID NO: 33057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccctggcgctttggttctcgagcaggtgt

SEQ ID NO: 33058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgaaacgtaatgtacgtatcggtttatt

SEQ ID NO: 33059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgaagctataccgatccatcgccccgtg

SEQ ID NO: 33060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgacaatagtttgcgcgggggcaacggt

SEQ ID NO: 33061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgaccttaagcgtagttcccccggggcg

SEQ ID NO: 33062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgacgccgggctgttcctggaacaccgt

SEQ ID NO: 33063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgacggcatccgggttaaggccttcatt

SEQ ID NO: 33064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgacttggcttgcgaacggatgtacggt

SEQ ID NO: 33065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgagagtttgaaccgctcaagggcgcgc

SEQ ID NO: 33066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgaggtcactctctgccgggcttcgatg

SEQ ID NO: 33067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgataagaacccccaggaccgacgactg

SEQ ID NO: 33068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgccgagtgcattaaacggatgcaccat

SEQ ID NO: 33069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgctcatcccctccctggtcaggttgta

SEQ ID NO: 33070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgctcctacgctattctaacttcctata

SEQ ID NO: 33071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgcttcacgaatttctcgaattcgaatg

SEQ ID NO: 33072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccggcaaggtgctgcaagttttgtgaccg

SEQ ID NO: 33073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgggcaatatgaactctgatcgttactg

SEQ ID NO: 33074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccggggactagcgggggtaaggctcgata

SEQ ID NO: 33075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgggtccctgcttaccgttacccatatg

SEQ ID NO: 33076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccggtccgttggccgctatcctgacaagt

SEQ ID NO: 33077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccggtcgaagaatgaagatgtatcggtag

SEQ ID NO: 33078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgtaagggcctcgagtcctgacgacgtt

SEQ ID NO: 33079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgtccttaccgattgccccttaagctta

SEQ ID NO: 33080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgtgcgtcttaccttacttactgggtct

SEQ ID NO: 33081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgtgtattgatgttcgtttcatgtaagg

SEQ ID NO: 33082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccgtgttgacgaaaggaaattacattatc

SEQ ID NO: 33083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccctaataacgctacttgtattccccccga

SEQ ID NO: 33084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccctacgtcgaaccgtaccctgcaataacg

SEQ ID NO: 33085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccctagcttcgtggattattgatgtatgac

SEQ ID NO: 33086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccctaggtcttacgttgaaggattccgctt

SEQ ID NO: 33087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccctatgcttgctagtggttgttgtctact

SEQ ID NO: 33088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccctatggcgggggatacctcgtgggattg

SEQ ID NO: 33089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccctatttcgactcccgaaccttgtctgtg

SEQ ID NO: 33090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccctcactacggttggtactggtcatgggg

SEQ ID NO: 33091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccctcatgccggtcggagattgctatggtg

SEQ ID NO: 33092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccctcattcttttgcagaaaccttgcatct

SEQ ID NO: 33093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccctgacggccgagagcgatcttactgcga

SEQ ID NO: 33094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccctgcggtcgaattgttggctgttttcca

SEQ ID NO: 33095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccctgctatcgttgccatcttttgtcgccg

SEQ ID NO: 33096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccctgctcgctaagagggacacgttctcgg

SEQ ID NO: 33097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccctggctaggtgagagcgtcggtgcattc

SEQ ID NO: 33098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccctgtcctgcgggataccgggcgcggaag

SEQ ID NO: 33099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccctgtgtgtcttgagcatacgctactggg

SEQ ID NO: 33100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccttgcgtacgctataaaacgacaatctg

SEQ ID NO: 33101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccttgggtcccgaagttgcatttttcggc

SEQ ID NO: 33102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcccttgtgtagagatcccttgtgtagaagg

SEQ ID NO: 33103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgaaacgtctatccctcacgctgcgtcgt

SEQ ID NO: 33104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgaaatggacgcgtgctttggcgtgtgca

SEQ ID NO: 33105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgaaccgagtttgtcgaggcagcaccaag

SEQ ID NO: 33106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgaacggtgacgcacttcgtgttccgatg

SEQ ID NO: 33107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgaatgcaagggaggcatgtgggttgaca

SEQ ID NO: 33108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgacatatgtagcggtgtgcacaattgtg

SEQ ID NO: 33109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgactgtggcaacgacgcgttacttcggc

SEQ ID NO: 33110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgagccttaatatatatttctttctggag

SEQ ID NO: 33111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgagcgggtgggaaatcggtcccggcaga

SEQ ID NO: 33112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgaggaagcggatcaatggaatcagacgg

SEQ ID NO: 33113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgagggcatttcctgcaacttcgcaacgt

SEQ ID NO: 33114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgagtggactcgaatgtgccatgggcata

SEQ ID NO: 33115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgataaatcagaattccgaacacatccat

SEQ ID NO: 33116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgatactacacagatgttacgtcgagact

SEQ ID NO: 33117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgatagttagcggttgtcccttcgcctta

SEQ ID NO: 33118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgatattcgctaaacagctctgatgccgc

SEQ ID NO: 33119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgatgagagttgatggcgcggttggtacc

SEQ ID NO: 33120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgatgggagaagtgtagtatcggagagtg

SEQ ID NO: 33121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgatgtagccaagagggtaccaagacgtt

SEQ ID NO: 33122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgattcgtcgggtatcatcttgtcgagca

SEQ ID NO: 33123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgcaacacgtggtcctcttgttggaccct

SEQ ID NO: 33124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgcccaaggagcattttgggccaccccgc

SEQ ID NO: 33125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgcgaacgctcgacagctccctgattgtg

SEQ ID NO: 33126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgcggagtatcctcatccactgtttagac

SEQ ID NO: 33127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgcgtggcccaatgtgactctgctttgcg

SEQ ID NO: 33128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgctaacttctattcgtttgatttggcgg

SEQ ID NO: 33129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgctaccgttaatcgtatgcatcgcatta

SEQ ID NO: 33130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgctgcgtccccttcatctcgagctagaa

SEQ ID NO: 33131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggaaagtaaggggcgcgctttatgaacc

SEQ ID NO: 33132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggaacgataatgctaaacgtatgtcaca

SEQ ID NO: 33133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggagagccgtcgggttgtaacagtcgcg

SEQ ID NO: 33134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggaggtgctaggtctttgcttctcgcgg

SEQ ID NO: 33135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggagtgtgaagccccggccaacatgggt

SEQ ID NO: 33136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggatcgtggcatggcggatgcaggacca

SEQ ID NO: 33137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggattcagatagcgtcatcgtaatcggc

SEQ ID NO: 33138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggattgtcctaaccgggacaattagcgg

SEQ ID NO: 33139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggcacgctactcctttgaatgtaccgtt

SEQ ID NO: 33140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggcacgtacggctcacttttgcggtgtc

SEQ ID NO: 33141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggcactacgagattaatctcggctcttg

SEQ ID NO: 33142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggcagtaaggcggctctcggtttctcgc

SEQ ID NO: 33143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggcataatgcactcgttcatcggcccga

SEQ ID NO: 33144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggccgcctcgaaaatcttgatctcgcgt

SEQ ID NO: 33145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggcctgcttctaagcaaggtatctgtgc

SEQ ID NO: 33146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggcgctggttgggcatggtggtgatcgg

SEQ ID NO: 33147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggcggtaatgcagacagcacttatggta

SEQ ID NO: 33148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgggaggcgagacggtaaatcgggcggcg

SEQ ID NO: 33149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgggagtcgtaaacacggaatggcataat

SEQ ID NO: 33150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgggatggcggaaagcggtaaattacact

SEQ ID NO: 33151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgggcagcaggatactctgacacccactt

SEQ ID NO: 33152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgggccctctgatgctctagcttggttct

SEQ ID NO: 33153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggggaccttgcttatgttgccattgaat

SEQ ID NO: 33154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggggcgttagctcgtttgagtttgtgct

SEQ ID NO: 33155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgggggtacgcatgctgggctctctcctc

SEQ ID NO: 33156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgggtggtagggttatctgggaggtacgt

SEQ ID NO: 33157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggtacaatgtgcactcgccggtgttcga

SEQ ID NO: 33158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggtactctagctcgtgactaattcaggg

SEQ ID NO: 33159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggtccaactttagtattcaattacgtaa

SEQ ID NO: 33160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggtctccgctattgtagtcccgatggtg

SEQ ID NO: 33161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggtcttcctggcagctgtagcgcattcc

SEQ ID NO: 33162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggtggtggctccgaccggtggattttat

SEQ ID NO: 33163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccggtttggggacggtggggtacatgaggg

SEQ ID NO: 33164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgtaactctagttgttgcatattgtcagt

SEQ ID NO: 33165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgtagagcgttatgtgtacaacggggcgt

SEQ ID NO: 33166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgtattcggctggattcattgcgggttaa

SEQ ID NO: 33167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgtcgctgtcctgtctgcctcatcgttag

SEQ ID NO: 33168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgtcgtcgttcgttgtatccggctggacc

SEQ ID NO: 33169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgtcgtgcaagagagtcctgaggccgatc

SEQ ID NO: 33170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgtctacacttgtcgcggctggctgggtg

SEQ ID NO: 33171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgtgaatgaagtgctgtctatgtgtccgc

SEQ ID NO: 33172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgtgacggcccttagtcgacgggttgcca

SEQ ID NO: 33173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgtgatagcagttactggacggctagggg

SEQ ID NO: 33174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgtgcaaggacaggcgagggacctgacgc

SEQ ID NO: 33175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgtggaatgactctgtcccaagtatgctt

SEQ ID NO: 33176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgtggcaaacactctcgtttcgagtagtc

SEQ ID NO: 33177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgtggccgctagggaaataatggggagtt

SEQ ID NO: 33178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgtgttagtttgcggcatacagcggtacc

SEQ ID NO: 33179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgttacaaacctcgttgaggccagccatt

SEQ ID NO: 33180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgttacaggttagtgccctctatcctctt

SEQ ID NO: 33181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgttcaggggttcgtccaccgctcgttgt

SEQ ID NO: 33182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgttcccttattactaccgtgcgattgac

SEQ ID NO: 33183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgttcgattaagtatccccaagaggtcgg

SEQ ID NO: 33184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgttgtattatacttctcaattggtttaa

SEQ ID NO: 33185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccgttttctcgtcttgccttgatcttaggt

SEQ ID NO: 33186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctaaagctggcgagggctgtagtacgggg

SEQ ID NO: 33187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctaactcgttgaataatcggtgggaattg

SEQ ID NO: 33188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctaagctttcaattctacagaaacgtgtg

SEQ ID NO: 33189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctaatacccgctttaaccaccgtgcgggc

SEQ ID NO: 33190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctaatggggtgtcagggggtttcatgctt

SEQ ID NO: 33191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctacactggtgttagccccaccgcaatgt

SEQ ID NO: 33192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctacgcgacaagatctcatgcgttgcggt

SEQ ID NO: 33193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctagaactggataagccatttggggtcgt

SEQ ID NO: 33194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctagacgattggaggaagttccgccggct

SEQ ID NO: 33195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctagattcaacctttagagttcatgctaa

SEQ ID NO: 33196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctaggaaagactgttgtgtcggcagaaga

SEQ ID NO: 33197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctaggtaggtaccactcatgcacgtcgct

SEQ ID NO: 33198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctatcgacttatgattaaaacctgtcttg

SEQ ID NO: 33199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctccatctaccgaagaaagcaagtacgag

SEQ ID NO: 33200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctcccaaccgcgtgtaatcaagtcgcccg

SEQ ID NO: 33201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctcccgtccacgagctgatcagatccagt

SEQ ID NO: 33202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctccggcagttggtaggactcgggccaag

SEQ ID NO: 33203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctccgttagacatcgcggatatcacgccg

SEQ ID NO: 33204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctcctcgagtcgtggagcgtcaggtgccc

SEQ ID NO: 33205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctccttacgacatctcccggcacatctcg

SEQ ID NO: 33206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctcgacaaagcaccagtgtagaaagggct

SEQ ID NO: 33207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctcggtgctctcttccgaatggcgggtga

SEQ ID NO: 33208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctcggttaattagttactcgggttgttag

SEQ ID NO: 33209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctcgtcatgctttttttgagaatgcgcca

SEQ ID NO: 33210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctcgtcccctgtcagggataagaactgaa

SEQ ID NO: 33211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctcgtggtaagagcgtaatcagggactgt

SEQ ID NO: 33212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctcgtttcgttgcgtatgttcgggagttc

SEQ ID NO: 33213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctctccctgcacatgtcaaaactttagac

SEQ ID NO: 33214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctctcggttacgctttaagtatgccggac

SEQ ID NO: 33215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctctgtctatatcttcgcgcatgtgtaac

SEQ ID NO: 33216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctctgttcaggccacatcatgcattggac

SEQ ID NO: 33217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctgaagccgtatgcctgacactaacgtcc

SEQ ID NO: 33218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctgacagcgcgaaggcggcgctcgttgtt

SEQ ID NO: 33219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctgaccttggacggtgttatatcagtggg

SEQ ID NO: 33220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctgaggtgccagcctttgcaatgtatgcg

SEQ ID NO: 33221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctgattagtaaggtaaatgggcacgttat

SEQ ID NO: 33222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctgcacgcttaacaagcgaacgatggata

SEQ ID NO: 33223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctgcgcggatgcagacaactttgtagtta

SEQ ID NO: 33224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctgcgtgttacatgggctatcgactattg

SEQ ID NO: 33225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctgcgttatgcctggatggtcttaagcca

SEQ ID NO: 33226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctggacgtgttatatgactctgatgatca

SEQ ID NO: 33227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctggagtgtatgactttactgaccttggt

SEQ ID NO: 33228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctggatcaagaaagttcagcaactttttg

SEQ ID NO: 33229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctggctaggaatcgcgtctggttatcaac

SEQ ID NO: 33230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctggggccggtcctgcttacaccatcacc

SEQ ID NO: 33231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctggggtgcacgcgagagttaggtaagcg

SEQ ID NO: 33232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctgggtctgaaaggccttatggtatcatt

SEQ ID NO: 33233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctggtccagtcatgtcaaattacacagcg

SEQ ID NO: 33234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctggtgaagtgctgattcatatgtttcgc

SEQ ID NO: 33235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctgtattgtcagcaacacatgtgactgga

SEQ ID NO: 33236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctgtctacgtcggattttccagtcatcta

SEQ ID NO: 33237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctgttacggttctcgttcgtgtgagtgcg

SEQ ID NO: 33238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctgtttatgtttacttcatgagtatgtgg

SEQ ID NO: 33239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccttagccggcatcatcgtcaaaagttcgt

SEQ ID NO: 33240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccttagctgttacaaggttacacccagtat

SEQ ID NO: 33241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccttcattggttccctattccgggagatcc

SEQ ID NO: 33242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccttccccggccaagatggcatccggtaga

SEQ ID NO: 33243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccttcgcggttagcagtccaggggcaactg

SEQ ID NO: 33244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccttgcccgcttggtagagctatccaatga

SEQ ID NO: 33245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctttatcagtgactgcgagagttttcacg

SEQ ID NO: 33246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctttcgctggggggtggtggccatgctcg

SEQ ID NO: 33247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcctttgtgaaataacacgtttggtaggcgg

SEQ ID NO: 33248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctccttttagcggtatcacgtgatacatggag

SEQ ID NO: 33249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaaaaaagtaccggacttaggcattgcac

SEQ ID NO: 33250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaaaataagcagtcacggagggcaagtcc

SEQ ID NO: 33251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaaacagaacggagcacatttatcagttt

SEQ ID NO: 33252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaaacgactttgggggtccatgcatgtag

SEQ ID NO: 33253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaaactgacccatcttctgatctctgctc

SEQ ID NO: 33254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaaagaagccaaacgcgtgtcagcttctc

SEQ ID NO: 33255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaaaggataggtcactttggactttccac

SEQ ID NO: 33256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaacaaagtagagggagtcgccgtagatg

SEQ ID NO: 33257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaacgcattcctcgaccgggtcatactgt

SEQ ID NO: 33258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaacgctgtggagcccgggttgtgtggca

SEQ ID NO: 33259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaacggattcgtttcgcgcactgtgtagg

SEQ ID NO: 33260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaacgggtatgcgcgtgtctattaggccg

SEQ ID NO: 33261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaacggtccgtgagaacatgtggcccgct

SEQ ID NO: 33262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaactgggaccgtcatccttaagatgcac

SEQ ID NO: 33263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaagacttccgatgattgcgctccgtcgt

SEQ ID NO: 33264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaagcccccaagaatggctacgggatacc

SEQ ID NO: 33265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaagcgtgctcctcctaatccttgccctt

SEQ ID NO: 33266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaagctacacgtggggtttctcctatagc

SEQ ID NO: 33267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaagctactatacatgttgtataaaggct

SEQ ID NO: 33268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaagttgatgggccatcgctaatcgcatt

SEQ ID NO: 33269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaatcctcagcggtcgaacggtcctcttc

SEQ ID NO: 33270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaattcatttggactggcaatccgcggat

SEQ ID NO: 33271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacacaggggactaagggctcgtaagcac

SEQ ID NO: 33272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacaccgaaatatttctagtggcaagttc

SEQ ID NO: 33273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacacgcccgtactcggtctgtacacgca

SEQ ID NO: 33274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacagaacctggcgccgacaccaaggggc

SEQ ID NO: 33275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacagctcacggggtcatggtcctggcgc

SEQ ID NO: 33276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacagtctggttgagtcaatattgatcga

SEQ ID NO: 33277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacagtggcgctatgggatgcaggttccc

SEQ ID NO: 33278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacatatcggcggcggctggggtagtcgg

SEQ ID NO: 33279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacatcatcctcgctggaagtgtagtggt

SEQ ID NO: 33280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacatctggccacgtattcggattcccgt

SEQ ID NO: 33281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacatgtcaggggagatgcggcgtgaccg

SEQ ID NO: 33282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaccaagagggatcatctaactttgactc

SEQ ID NO: 33283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaccaccatggctcctgtctccacgttga

SEQ ID NO: 33284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaccactacatgcagtccagggggtgagt

SEQ ID NO: 33285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaccaggcacaacggatattgcaggggtt

SEQ ID NO: 33286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacccatgcacaatggttagtggtttcga

SEQ ID NO: 33287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacccggagcactgatttgaagaccgtcc

SEQ ID NO: 33288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaccggataacgtcactgacccccgttct

SEQ ID NO: 33289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacctaacatgtccgtgtaagagattgcg

SEQ ID NO: 33290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacgagaagtggtaaagactgtgcgctcc

SEQ ID NO: 33291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacgatatgttacagattaagtgcgtgtg

SEQ ID NO: 33292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacgccgacgggagcattgctatacgcca

SEQ ID NO: 33293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacgccgtctctttggatggtctcgggac

SEQ ID NO: 33294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacgcttgcatgtctggatatactgcagg

SEQ ID NO: 33295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacggaaagggccaagacaatctgacttg

SEQ ID NO: 33296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacggacgtgtcagacgctcccttatgtc

SEQ ID NO: 33297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacggatctgactggcatttcgagtccgt

SEQ ID NO: 33298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacggcggtatgttgttacctgggttagg

SEQ ID NO: 33299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacggggtgaattggcgcatgtttggtcg

SEQ ID NO: 33300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacgggtggcaagcttggtccgtcccatt

SEQ ID NO: 33301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacggtcaatctcctacggttggctgtgt

SEQ ID NO: 33302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacgtctccagcacttcgtctagccaaat

SEQ ID NO: 33303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacgtttgccgaatcaccaatcctcaggt

SEQ ID NO: 33304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacttatgtgctggggaccttgttttttc

SEQ ID NO: 33305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgacttgcaaggcttattacataggtatac

SEQ ID NO: 33306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgagagagaagcttacgtgtccttcagctc

SEQ ID NO: 33307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgagagggttacggggtgaagaggggtgag

SEQ ID NO: 33308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgagatcgggagtgggagacaacagctggt

SEQ ID NO: 33309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgagcaaactcgctgggcaacgaacgaggg

SEQ ID NO: 33310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgagcgggtccgaatgttcagataacggtc

SEQ ID NO: 33311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgagctgcacagacttcaacttcgcgactt

SEQ ID NO: 33312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgagctgtcacgttccacgccaagagtctc

SEQ ID NO: 33313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaggacaagaactcctatgtgaatgggtg

SEQ ID NO: 33314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaggcgagactcccgaggtgggtgaccct

SEQ ID NO: 33315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaggcgctcgcaaacgtttccactatgct

SEQ ID NO: 33316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaggcggcgtttggacgtatatggttggc

SEQ ID NO: 33317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgagggaacgctcttataatgttattaagg

SEQ ID NO: 33318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgagggccgctagacgttggagagtgctcc

SEQ ID NO: 33319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgagggcggctgaacattgggcatcttcga

SEQ ID NO: 33320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaggggggaggtctcggcagttggctcct

SEQ ID NO: 33321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaggggtcaatgggcaggtagggtcgagg

SEQ ID NO: 33322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgagggtgacggccaagtgtgtgtctgcgt

SEQ ID NO: 33323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgagggtgagggataaaggaggcacaactc

SEQ ID NO: 33324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgaggtatgtgccatcaccatctaagcttg

SEQ ID NO: 33325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgagtaggattcaacagagccactggcgct

SEQ ID NO: 33326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgagtcaaagctctattaagcgtctgtacc

SEQ ID NO: 33327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgagtcatagaaaccttactcgcaggggtt

SEQ ID NO: 33328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgagtccgcgccgtaagagtgcctccaccc

SEQ ID NO: 33329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgagtggtgaacagtatcgttgtgtttagt

SEQ ID NO: 33330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatacaaaacattgagctggcaaggactt

SEQ ID NO: 33331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatacaccagacaggatgcgtggtttggc

SEQ ID NO: 33332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatacccctgttacccttcaacgtggccg

SEQ ID NO: 33333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatactgtcctgacttgttgtgcgttacg

SEQ ID NO: 33334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgataggtagcccacacgccagccggttgt

SEQ ID NO: 33335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatcacttggctagtgttccattttcagt

SEQ ID NO: 33336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatcagaactactcgttgtcccgttagct

SEQ ID NO: 33337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatccacgatgtcctctccggggttcgcc

SEQ ID NO: 33338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatccattcggctgtcggatctgcggttc

SEQ ID NO: 33339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatccccacggcacacggcctgctaattc

SEQ ID NO: 33340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatccgccttctcggcatccttgacccgc

SEQ ID NO: 33341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatcgatgtgacattcgacgtggggtcga

SEQ ID NO: 33342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatcgattgcagtttacaggatgttaggg

SEQ ID NO: 33343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatcggttatttttcgctccccactgcgt

SEQ ID NO: 33344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatcgtggattcacttgtgactagctgta

SEQ ID NO: 33345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatgaaaccctttgagacgttcggtgcgt

SEQ ID NO: 33346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatgacggtgctaggacgcatgttgggcg

SEQ ID NO: 33347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatgattgggtatctcggtttacgcagtg

SEQ ID NO: 33348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatgcgagtggtgggatcctaataacgca

SEQ ID NO: 33349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatggaaaccctcgaattggcttgcaacc

SEQ ID NO: 33350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatggcggtcatacagcctttttcacttg

SEQ ID NO: 33351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatggtcaagacttaacaccctctcgcct

SEQ ID NO: 33352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatgtaatcattgtacacctccgtgctcg

SEQ ID NO: 33353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatgtctctctctgggggcagctgacacg

SEQ ID NO: 33354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgattcgcagtacatggtcgtgcttgtgaa

SEQ ID NO: 33355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgattggatagacacctcagcttttttcct

SEQ ID NO: 33356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgatttacaccagatactcctatggtaggg

SEQ ID NO: 33357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcaaaggacaagcctgcatacctcagccc

SEQ ID NO: 33358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcaaccaggggccaaggtcataccggcta

SEQ ID NO: 33359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcaacctttagaacctttcggcgtaacaa

SEQ ID NO: 33360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcaagcagaccgtcgatgaccttggcggt

SEQ ID NO: 33361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcaagcccgacacataaccgtaatggcgt

SEQ ID NO: 33362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcaatcatatgtcttacatgttacgcctc

SEQ ID NO: 33363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcaattaggccatcatcgcttcaaccagt

SEQ ID NO: 33364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcaattgggacaggttgcaggtatcgtag

SEQ ID NO: 33365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcaatttgtcctggttggtgcgggatgcg

SEQ ID NO: 33366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcacaagatgtaatatcacgtaacaggcg

SEQ ID NO: 33367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcacactaatggttgcacgagattacctc

SEQ ID NO: 33368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcacatcagttcgcacgaatccaacgtct

SEQ ID NO: 33369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcaccgccatttaatgtagggtcaagcgt

SEQ ID NO: 33370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcaccggattgctagatgctggcttctcg

SEQ ID NO: 33371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcacgcttgacctactactatggaatggg

SEQ ID NO: 33372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcactgaatgagtgttaggtggcgaggtc

SEQ ID NO: 33373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcactggccagatgtactaccggtcttag

SEQ ID NO: 33374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcagccctagtggcccggtccgtggtaac

SEQ ID NO: 33375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcagcgtggttcgatcctggttcaggttg

SEQ ID NO: 33376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcagctcatgttgtcttgatagacagtag

SEQ ID NO: 33377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcaggtcgagggtggaggggcgttgctgt

SEQ ID NO: 33378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcataaccgcatatgtggcattcagcgtt

SEQ ID NO: 33379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcatagttaagttgtaggaatggctgtcg

SEQ ID NO: 33380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcatcctccgcaaccttgtccttatccga

SEQ ID NO: 33381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcatctctacgttaaacggcgaccttccc

SEQ ID NO: 33382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcatgggcccagacgaaggatcggaacct

SEQ ID NO: 33383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcatgtttaaactgagatttagattgtgg

SEQ ID NO: 33384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcatttactacatgaaatggcccttcacc

SEQ ID NO: 33385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgccatctaaatcaaaaggtggtccgcttg

SEQ ID NO: 33386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgccatggtatcgacaacgggtccactgta

SEQ ID NO: 33387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcccaactgtaatcgatgggacggcggtt

SEQ ID NO: 33388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcccatgtgtatcgtgtggactatcatcg

SEQ ID NO: 33389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcccccaagttgtgattaatccgtcaggg

SEQ ID NO: 33390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcccgatcaagtcacgccgagatgcgttc

SEQ ID NO: 33391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgccctagggtggtttgagcagcatcatgt

SEQ ID NO: 33392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcccttaggatggtcgtgacgccctagtc

SEQ ID NO: 33393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgccgattcatacccttcgtttcagtgttt

SEQ ID NO: 33394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgccggccaagctacccgcccctgaatgtg

SEQ ID NO: 33395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgccggcgttttttcctctgtgcaccgtaa

SEQ ID NO: 33396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgccggctcgttcggaaattggatcggatt

SEQ ID NO: 33397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgccggttactggaggacgtatgttccccg

SEQ ID NO: 33398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgccttaggcttgcacgttcttgccacagg

SEQ ID NO: 33399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcgaatcagcgcgatagcatctatcgacg

SEQ ID NO: 33400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcgaccttttcgtgcaacttggctgcggg

SEQ ID NO: 33401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcgagacactaattggggttgactgtacc

SEQ ID NO: 33402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcgagcggggtatgtagcggccgtggcaa

SEQ ID NO: 33403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcgaggcttctgtatcgccgggaccagcg

SEQ ID NO: 33404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcgagttccccgtcctggcgtggttgtga

SEQ ID NO: 33405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcgatagcacgatgctgtgtgcgctggca

SEQ ID NO: 33406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcgctaacctaatagtatgtggtactcct

SEQ ID NO: 33407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcgcttcatagacacagatggattcgcca

SEQ ID NO: 33408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcggaatgtgccatggggtgaaaggccga

SEQ ID NO: 33409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcggatcccggcatgatccttagaaaaat

SEQ ID NO: 33410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcggatccgttgcggtaaatataggctcg

SEQ ID NO: 33411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcggcaggggtgccctccatgggtgggac

SEQ ID NO: 33412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcggcagggtcaatttctccctagcgatg

SEQ ID NO: 33413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcggctgctgatgatcatcggaatccttg

SEQ ID NO: 33414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcggctgttattgaaagggacatactcct

SEQ ID NO: 33415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcggggatttgggccaactgtgactgatt

SEQ ID NO: 33416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcggtaggcgatttggcgatgatgacgga

SEQ ID NO: 33417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcggtcccactgcgttatttgcaatgagg

SEQ ID NO: 33418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcggtcgtctccggtcaatataagcctct

SEQ ID NO: 33419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcgtaaaaggtggttattggctcattcaa

SEQ ID NO: 33420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcgtagattgagggattttcggtgctcgg

SEQ ID NO: 33421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcgtcacacaggcgattatgcctcggtct

SEQ ID NO: 33422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcgtcgggtgggcagcagatgctagtcgg

SEQ ID NO: 33423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcgtgccatagagcttggaatcaatccgc

SEQ ID NO: 33424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcgtgtgtgatagggcagagatttgggcg

SEQ ID NO: 33425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcgttgtggtatactcagtaggacgcttc

SEQ ID NO: 33426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgctaagacggggacggtaaagcccccgca

SEQ ID NO: 33427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgctacaaggctgtactcgcccggtatatg

SEQ ID NO: 33428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgctactgttgttggatggcgacgctcagc

SEQ ID NO: 33429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgctagatttcgttcgaatccgaggggtcg

SEQ ID NO: 33430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgctcagactcgagtgatcgttaccatagg

SEQ ID NO: 33431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgctcagccattacgtgaagcatcactcta

SEQ ID NO: 33432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgctcaggcaaaacgtttacattcttgtca

SEQ ID NO: 33433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgctcccactccaccgggccagtacgcacg

SEQ ID NO: 33434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgctccttcgctgtctgcttattactaccg

SEQ ID NO: 33435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgctcgtgcgttcagttggccgattgacac

SEQ ID NO: 33436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgctctcactttacacttagtggcttccct

SEQ ID NO: 33437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgctctcctcaacattatgctagtaatcgg

SEQ ID NO: 33438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgctgattcgcttagtatgatatgtcaccc

SEQ ID NO: 33439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgctgattgggcgttcttgttttcgttgtt

SEQ ID NO: 33440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgctgctagcctaaccggggtagttgggtg

SEQ ID NO: 33441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgctgggctaacccaacccggccatattcc

SEQ ID NO: 33442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgctgtttcgctgagtacaattgctagccg

SEQ ID NO: 33443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcttcacttccgccctgctgtgtgttccc

SEQ ID NO: 33444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcttccaacttacaaggacacggtcacga

SEQ ID NO: 33445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgcttcgtggccgattacggcatgacggca

SEQ ID NO: 33446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggaacgagtcgacgtcagcgatcggtgcg

SEQ ID NO: 33447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggaacgggatcaaaccatcgtatgaaggc

SEQ ID NO: 33448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggaagccttagcgatccgtaggggcttgt

SEQ ID NO: 33449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggaagggtcaatgagacgacgagaccccg

SEQ ID NO: 33450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggaattgtgttctccggaagtattgcctc

SEQ ID NO: 33451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggacaacacttgatgcatcgcaatccaca

SEQ ID NO: 33452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggacaagcaccattcccttgaggttacca

SEQ ID NO: 33453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggacaatctccaaatagcccgtgcggtgg

SEQ ID NO: 33454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggacaccgggggaggatgcgtccggttgt

SEQ ID NO: 33455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggaccacatgcacattagctttttctggc

SEQ ID NO: 33456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggacgaccgcgaattggtgtatcatgcga

SEQ ID NO: 33457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggactcttatgagtgataagcaggtagat

SEQ ID NO: 33458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggagatgtgccggtttaggattacggagg

SEQ ID NO: 33459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggagatttcaccgccctatccctaagtgg

SEQ ID NO: 33460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggagctctgtgaggatgcggtaaggctgc

SEQ ID NO: 33461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggagggccagtggcggctggctcagtatt

SEQ ID NO: 33462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggagtgtcacgcctgggctacttggctta

SEQ ID NO: 33463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggagttcagggcttgtatacacggtaagt

SEQ ID NO: 33464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggatcattttgtgaccccggggcattgat

SEQ ID NO: 33465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggatccaaaatcccgttgctatcgagatg

SEQ ID NO: 33466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggatcgatttctgtctgtgatagcaagcc

SEQ ID NO: 33467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggatttttattagtgctgcacgatgctcg

SEQ ID NO: 33468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcaacgcgttaggcgacacagcagcggc

SEQ ID NO: 33469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcaagctggttcgtcggtcttcgtacta

SEQ ID NO: 33470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcaaggactctcataacgtggcatgctt

SEQ ID NO: 33471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcaatgtactccgacgctgaaccgcgtc

SEQ ID NO: 33472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcaattacctcgtttggctttccttgag

SEQ ID NO: 33473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcaccggggcacaaatattccccgctcg

SEQ ID NO: 33474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcaccgtggctgcatgttacagcgctgg

SEQ ID NO: 33475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcactgcaactccccaccttatcgcgtg

SEQ ID NO: 33476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcagactggtccccaaacgcacactcct

SEQ ID NO: 33477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcagagggaccacggcgaatgagcgagg

SEQ ID NO: 33478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcagccaggaacaccaccagtagacgcg

SEQ ID NO: 33479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcagccgaattctttgataaaaattacc

SEQ ID NO: 33480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcagggccaatttttgcagtagggctat

SEQ ID NO: 33481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcagtattcggctctcaaggattgtatg

SEQ ID NO: 33482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcatagaaccagtgatggtggctgggcg

SEQ ID NO: 33483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcatgagcgtgtctttcgtcgtggtgac

SEQ ID NO: 33484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcattcatcgcgacgcacgggcttggta

SEQ ID NO: 33485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggccacggagttgcgcttcgtcggaggta

SEQ ID NO: 33486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggccgactctgcccaaaggtgtagcggtg

SEQ ID NO: 33487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggccgcgatttccctggcctttcagtctg

SEQ ID NO: 33488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggccgctccgcatttccataagtctagtt

SEQ ID NO: 33489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggccggggcacagggaacgggtagttgtg

SEQ ID NO: 33490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcgacacggggctcggtttgatggaaac

SEQ ID NO: 33491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcgatctggactgacggtgaagttaagg

SEQ ID NO: 33492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcgcatattgttaggtatcgtgcacgtt

SEQ ID NO: 33493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcgctcaccgtagcagcttcatcggtgc

SEQ ID NO: 33494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcgctgggcggtagatcatcgcgttgtc

SEQ ID NO: 33495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcggacgataacgtttgtgtcccggata

SEQ ID NO: 33496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcggcaggtgtttacagtctcattgcgt

SEQ ID NO: 33497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcggggcttacttgctgattccgggacg

SEQ ID NO: 33498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcggggggctgctccaaccattttgggc

SEQ ID NO: 33499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcgggtgacattgcggggtgtgcgccac

SEQ ID NO: 33500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcggtgtgcagctgtcccctcatgaaac

SEQ ID NO: 33501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcgtcggcactgcccagtcatggtgtat

SEQ ID NO: 33502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggctaatatgcgcccgtagcaactcactc

SEQ ID NO: 33503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggctacctggttgaaccttaggctggtag

SEQ ID NO: 33504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggctatctcgggtggccgtttcgctaaca

SEQ ID NO: 33505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggctcacctcgtgcgatgtccgttggggc

SEQ ID NO: 33506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggctcactgcggattcatgacacggaagt

SEQ ID NO: 33507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggctctagtcttgtcgggtgggtaggtcc

SEQ ID NO: 33508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggctgatcgattaagtttcgtgcagtctc

SEQ ID NO: 33509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggctggcttgttgaccctctcaccattgg

SEQ ID NO: 33510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggctggtggcctgatgtctccgggaagct

SEQ ID NO: 33511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggctgtcgtttttgcatctccagcttacg

SEQ ID NO: 33512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggctgttcggagcagcttcctttgttcgt

SEQ ID NO: 33513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcttactatcttagttatgtgcggacgg

SEQ ID NO: 33514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggcttcactgaccggatcgtcgtcactcc

SEQ ID NO: 33515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggaacacggagattatgacacctgtcga

SEQ ID NO: 33516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggaagtgtttcttggcctcggcatgtgg

SEQ ID NO: 33517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggacgagtacaatttatcgttatttagt

SEQ ID NO: 33518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggagagggaccaagcggctcgtacacat

SEQ ID NO: 33519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggagcattcgaactcagcggtttcgacg

SEQ ID NO: 33520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggaggcgtaacttctccggttactgcgg

SEQ ID NO: 33521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggaggtcgaagtggagatcgcgcggccg

SEQ ID NO: 33522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggagtagatctgttacttagcatcaacg

SEQ ID NO: 33523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggatactcttcgtactctactgacggct

SEQ ID NO: 33524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggatagggcatcaagtagattttacgta

SEQ ID NO: 33525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggatcatcatggctctgtgaaggagtgt

SEQ ID NO: 33526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggatgatgaccgattatctttactagtt

SEQ ID NO: 33527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggattcatcttcaaacgtccgtccgtgt

SEQ ID NO: 33528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggcaaaaataagaatttacttggtcgac

SEQ ID NO: 33529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggcaccgcctcccttgtgattctgcctc

SEQ ID NO: 33530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggcaggcatctaccaacgttggtggcgt

SEQ ID NO: 33531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggcaggcctagtgcgcatgtgcatggtt

SEQ ID NO: 33532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggcagggcgttcttgcgcttgggtcgcg

SEQ ID NO: 33533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggccaatgtatacgtcttcgtgaccggg

SEQ ID NO: 33534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggcccagactcgtgcagaaaatcggacg

SEQ ID NO: 33535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggccgaacgcgggatgtcacggggtgta

SEQ ID NO: 33536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggccgatttacgggtgctatccgtggac

SEQ ID NO: 33537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggcgcggaacatttcatgtggatgctga

SEQ ID NO: 33538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggcggactctctcgtacccgcgtttatg

SEQ ID NO: 33539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggcggagaatcacaagttcgctcttacc

SEQ ID NO: 33540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggcggtcgttctcgacgtgaagccacac

SEQ ID NO: 33541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggcggttaagcagaacgacttaggagga

SEQ ID NO: 33542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggctcttgtaatccgtacacatgggcta

SEQ ID NO: 33543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggctggtccatcttcattttgcgattgg

SEQ ID NO: 33544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggggacaacggacaaggctgccaggaagg

SEQ ID NO: 33545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggggacgccatactccgcgggtgtcgtgt

SEQ ID NO: 33546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggggcagtagcagacctggtcggacgacg

SEQ ID NO: 33547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggggcagtatgcgcatatcggccttactc

SEQ ID NO: 33548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggggcctctctaataccgcacgctgggtg

SEQ ID NO: 33549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggggcttataaagtccagacgtggattgc

SEQ ID NO: 33550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggggcggaggttgacgttatgtcaattt

SEQ ID NO: 33551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggggggcgttgcacccgaccacgattgt

SEQ ID NO: 33552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggggtaagaggccacaggctcgtctcggg

SEQ ID NO: 33553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggggtcggacatcttgcgtatgctgcccg

SEQ ID NO: 33554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggggtctcctggactagccagtttccatg

SEQ ID NO: 33555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggggttacaattgggcggggactgtcggt

SEQ ID NO: 33556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggggttattcaaacgaaatagttgcggct

SEQ ID NO: 33557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggtaccaccaggatcgcggattgtgcca

SEQ ID NO: 33558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggtacgatgcaagttgatcgaggcttgt

SEQ ID NO: 33559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggtatcgggcggcaagagctgattcccc

SEQ ID NO: 33560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggtctcggtccaactgtcgcttcagcct

SEQ ID NO: 33561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggtctgcttggctaactaatacatggtt

SEQ ID NO: 33562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggtggtggacaagtgcacgacagcgcta

SEQ ID NO: 33563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggtgtatatatggcgcgctgtcgtgtcg

SEQ ID NO: 33564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggtgtgggcgttttagaagggccggtgt

SEQ ID NO: 33565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggttacgctattgaggtgattgttattc

SEQ ID NO: 33566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgggtttactcctgtacgaggtggagagtg

SEQ ID NO: 33567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggtactcgattgttattcaccatggattt

SEQ ID NO: 33568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggtagggcacagggcttctggcacgggga

SEQ ID NO: 33569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggtagtgttagttgcaccggacgcccaag

SEQ ID NO: 33570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggtagttaataccttaggattggcgcgac

SEQ ID NO: 33571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggtatcatacaattgtttgaaggccggga

SEQ ID NO: 33572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggtcaggatgaggggttccattttgcccg

SEQ ID NO: 33573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggtcattcgcgagggatgtgtatggtggg

SEQ ID NO: 33574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggtccctccagccttggtcgtcaacgtcg

SEQ ID NO: 33575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggtcgtgaaacatccgttccgccgtcgac

SEQ ID NO: 33576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggtctaacgtggtgtctcggcaggcgctt

SEQ ID NO: 33577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggtctcgcgtttacctggcgctccatata

SEQ ID NO: 33578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggtgaacctgaatttttttattcaccgtc

SEQ ID NO: 33579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggtgacgatcgcatcagcgggagatcggt

SEQ ID NO: 33580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggtgacgccactaaccggttggtcgcatg

SEQ ID NO: 33581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggtgctggagttttgtaactcgcgtaccg

SEQ ID NO: 33582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggtggcggctcggctgcgggcgcttcttg

SEQ ID NO: 33583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggtgggttgcgtacatcaaggcgcatcgg

SEQ ID NO: 33584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggttactagacgccggcagcgcaagacgg

SEQ ID NO: 33585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcggttcggttgagcattccttgtaaaccgc

SEQ ID NO: 33586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtaaagcccgctcccccttcctagagccc

SEQ ID NO: 33587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtaagtgctttccccgccaaaagtccatg

SEQ ID NO: 33588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtaatattcaaagaagagcattagccgcc

SEQ ID NO: 33589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtacaccagtttttgttttatggctccat

SEQ ID NO: 33590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtacagtgaggttgaagtaggaggaggtg

SEQ ID NO: 33591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtaccttccgtatgggtcaccagtttgtc

SEQ ID NO: 33592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtactcgctatagtggcgactcatgtccg

SEQ ID NO: 33593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtagcaattctggtgctgatggtgtttac

SEQ ID NO: 33594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtaggattttgctgccctgtttcttgcct

SEQ ID NO: 33595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtaggtttgtatctttctttacacgaaag

SEQ ID NO: 33596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtagtaacacaatggaacggagtaccaag

SEQ ID NO: 33597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtagtgttcaagtgaagtgaggttagaag

SEQ ID NO: 33598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtagttggcccctccacacctagttagcc

SEQ ID NO: 33599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtatagccgcgtctaatccgtgttacgcg

SEQ ID NO: 33600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtattctatataacgtgtttgtatgacgg

SEQ ID NO: 33601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtattgtgtcggagaatgttgtatacttg

SEQ ID NO: 33602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtcaacgttacggcacccaagttggccta

SEQ ID NO: 33603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtcaatgacaaaggcgctcaaggccggtg

SEQ ID NO: 33604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtcactcgggttcgatgtagtcaatgcct

SEQ ID NO: 33605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtcatacacacgggttgttggtggcggcg

SEQ ID NO: 33606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtccaaatacccgggtcaacaagcttcgt

SEQ ID NO: 33607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtccaccatactcttgtctctggatgtat

SEQ ID NO: 33608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtccagaacactccgggtgtgtgccggcc

SEQ ID NO: 33609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtccagcaatcatcactcggcagaccaag

SEQ ID NO: 33610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtccatacgtcaatgaatgcgatgatgtc

SEQ ID NO: 33611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtccgacttgcagcgtggggcttgtgtga

SEQ ID NO: 33612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtctacagcatcgtggtccagactcttct

SEQ ID NO: 33613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtctagttatctattgcggcgtcatccat

SEQ ID NO: 33614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtcttgtggaaccgaaacaagcgtttaca

SEQ ID NO: 33615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgacactggagcacccctcaaaggggcc

SEQ ID NO: 33616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgacaggaagaggaatggagggggcacg

SEQ ID NO: 33617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgacccaagaaaaatcgacaagcggggg

SEQ ID NO: 33618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgagactgatgtttgtgtggcacccgtg

SEQ ID NO: 33619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgagatagtgcgcgtaggaacttcggca

SEQ ID NO: 33620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgatccttgcacgttttttaattaattc

SEQ ID NO: 33621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgcacgatatatgctggaaggatttgcc

SEQ ID NO: 33622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgccaatcggttttccactttacgtcac

SEQ ID NO: 33623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgccggctacagtcgtccacttttcgga

SEQ ID NO: 33624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgcctgcgaaatgcaattcacgctttta

SEQ ID NO: 33625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgcgcaggatccgaccgttcagacgcct

SEQ ID NO: 33626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgcgcggcttattctccgaagttggtgc

SEQ ID NO: 33627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgcggatctaggggaagttcttcgtagg

SEQ ID NO: 33628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgcgggaaaaggcggggaaatttcaagg

SEQ ID NO: 33629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgcttgtcgttgacaggggcaatttgga

SEQ ID NO: 33630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgcttttactggtcgttccgcccctact

SEQ ID NO: 33631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtggacattgacgacgttcctgacctact

SEQ ID NO: 33632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtggattcattgaaaattttgtggggggt

SEQ ID NO: 33633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtggcaacgttatgcgtgaacttggcgta

SEQ ID NO: 33634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtggcgcgtaactcccggtgtcgtttgtc

SEQ ID NO: 33635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgggacgaatttttggacattcactcta

SEQ ID NO: 33636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgggtaacgtcatttcgcgcgcagattg

SEQ ID NO: 33637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtggtcatcggtccttcgggttcatcgtc

SEQ ID NO: 33638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtggtgcgtgttcaagactctagttgata

SEQ ID NO: 33639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtggtgttctgcgcataaattataggagg

SEQ ID NO: 33640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtggttcgaagtaactatttgttcgttgc

SEQ ID NO: 33641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgtacaagcggagctccggcgttcgttg

SEQ ID NO: 33642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgtacccgaaagtaaaggaagcgtctgg

SEQ ID NO: 33643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgtattatggtcataatcattgtacggt

SEQ ID NO: 33644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgtcccatttcagcatgtcatttggttg

SEQ ID NO: 33645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgtcctggaattcttggcacgctggttt

SEQ ID NO: 33646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgtgcctattagaggcacgtcaagcctc

SEQ ID NO: 33647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgtgcgtatcggtggaggacaacggatg

SEQ ID NO: 33648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgtgttataaggttcgtgctaggtcctt

SEQ ID NO: 33649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgttactgtgtcgtgtgctggcagtagc

SEQ ID NO: 33650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtgttgggtttgtgagcaatgcatcggag

SEQ ID NO: 33651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgttaccatttccctatgcccctgtttcaa

SEQ ID NO: 33652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgttacccatggggctaccgcgcttgggcg

SEQ ID NO: 33653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgttagcggttggattacgtatgctcagac

SEQ ID NO: 33654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgttagtgcaggtcgccattatgttcaatg

SEQ ID NO: 33655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgttatatagcttgttggacctgggcgctc

SEQ ID NO: 33656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgttatgtgtctttgcatgcaatctggcgt

SEQ ID NO: 33657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgttcaaactcaatccgtcatactagtggc

SEQ ID NO: 33658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgttccatacttgtccctgtggtacggtag

SEQ ID NO: 33659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgttcggaacggatagaaccgcccttggat

SEQ ID NO: 33660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgttctgcgtatacctgatctccgtgaact

SEQ ID NO: 33661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgttgattattcatctatggctagttccat

SEQ ID NO: 33662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgttgcaatccgagcgtcactggtatcgat

SEQ ID NO: 33663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgttgcactgtggaggcgatgctgctactt

SEQ ID NO: 33664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgttgcagggaatgggcctgtgtacattcg

SEQ ID NO: 33665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgttgcttacctggccgtttctgcgaaggg

SEQ ID NO: 33666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgttggcagaatcattttggctacttcgag

SEQ ID NO: 33667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgttgtttggggctgggtgattggacgttc

SEQ ID NO: 33668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtttaaggatcagtcagaggatctccgtc

SEQ ID NO: 33669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtttcggtctgattagtgttaggatgtgc

SEQ ID NO: 33670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtttcggtggcccccagctattggagggg

SEQ ID NO: 33671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcgtttggcttttgcggaagtttgggccttc

SEQ ID NO: 33672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaaaactataccggtaaatatggtaggct

SEQ ID NO: 33673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaaaataacgaagtacttgagctcacatt

SEQ ID NO: 33674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaaatcatagacgacttatgaatgcgcgt

SEQ ID NO: 33675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaaatcttttattgtcggcgtaatagtag

SEQ ID NO: 33676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaaatggccctttaccgacgggtgactgg

SEQ ID NO: 33677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaagcgaccgatggctctcatgtgatcct

SEQ ID NO: 33678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaaggcgcgggacaaaggttaggttaacg

SEQ ID NO: 33679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaaggggaagtataacctaaggaacggcg

SEQ ID NO: 33680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaagtctcaatttataacttacgcctcgc

SEQ ID NO: 33681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaagtggtggacgtgtggagctcccggcg

SEQ ID NO: 33682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaagtttggtgttccgtagaaacccctgg

SEQ ID NO: 33683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaatacgggacatcggggtttaaacactg

SEQ ID NO: 33684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaatttcaaggagttttactaactaggac

SEQ ID NO: 33685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctacaaatctgtattgtcatctgtagatcc

SEQ ID NO: 33686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctacaacccgcgagaagcgccctgctgtgt

SEQ ID NO: 33687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctacagcagcagcgctttggcctaccgggc

SEQ ID NO: 33688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaccataactatacttcgataatgggcgc

SEQ ID NO: 33689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaccctgcagtgctactcttgtttcgtac

SEQ ID NO: 33690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaccggtcagacgaactaccatttgaagt

SEQ ID NO: 33691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctacctgctggctaacgtcgcttgcctggg

SEQ ID NO: 33692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctacctggattgcgaaatgcggtggctatc

SEQ ID NO: 33693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctacgaggggaagcttgacacagaaggtac

SEQ ID NO: 33694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctacgccctccccttaagtgccgtgcggcc

SEQ ID NO: 33695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctacgcttatctctgcccagtgtattaacc

SEQ ID NO: 33696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctacggttcggtcctcgatcttcatggaat

SEQ ID NO: 33697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctactaccttgggaatcttcaggtacgggt

SEQ ID NO: 33698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctactatgacctcatcggtgcaagggattg

SEQ ID NO: 33699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctactggggtttcgttagcgaccaacccgg

SEQ ID NO: 33700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctagaagctgacaacggggagttgggatcc

SEQ ID NO: 33701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctagacgggagggccgttgctagtaattga

SEQ ID NO: 33702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctagaggccaggatcaaggaaggacagaga

SEQ ID NO: 33703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctagcactcgcccgttctatctggccacgc

SEQ ID NO: 33704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctagcatgcccgcttgggcagggtttcggg

SEQ ID NO: 33705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctagcggcacgaacgcgacgctcgacgcgg

SEQ ID NO: 33706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctagcgtagctgctaggggaagattgcggg

SEQ ID NO: 33707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaggatcggggccgagcgagcgattcggg

SEQ ID NO: 33708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaggctaacgcctaattgccaggctgatt

SEQ ID NO: 33709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctaggttcttaagtcggttttatattcaac

SEQ ID NO: 33710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctagtggacgtttcccaatgtttggccaat

SEQ ID NO: 33711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctagttctctattattgagtggtgctgttt

SEQ ID NO: 33712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctataataacagtagttcaatgtcagataa

SEQ ID NO: 33713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctatactacgaatgagtttacctcgacctt

SEQ ID NO: 33714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctatagggacaatgggatgagagtcacccg

SEQ ID NO: 33715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctatatagcgggggattgacgattcgattt

SEQ ID NO: 33716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctatcatcctgcgtatcatggcgattccgg

SEQ ID NO: 33717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctatcccgaccagtctccgcggaggttttg

SEQ ID NO: 33718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctatcccggaaggacttctcttggttggga

SEQ ID NO: 33719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctatctgcgcgtggtcctgggttaattatc

SEQ ID NO: 33720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctatggcagtagcagttgctgtgatgcttt

SEQ ID NO: 33721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctattactatcggtcaactacaaggggacg

SEQ ID NO: 33722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcaagtgtctgtcacttctgatgttttta

SEQ ID NO: 33723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcacagtagtgcccgactatcgcatcctg

SEQ ID NO: 33724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcacgtgaatcttaatcaagcgggcctat

SEQ ID NO: 33725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcactcagatacccctgccctggaggcgc

SEQ ID NO: 33726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcagcaccttcccagtgcggtcactatgc

SEQ ID NO: 33727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcagcgacgggaagcgagtgtttgcgttc

SEQ ID NO: 33728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcatatcccgttccggtccggagcagcgt

SEQ ID NO: 33729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcatccgtacgggcaagtagttgaagctt

SEQ ID NO: 33730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcatggcgtttccctttcctgcagtctgt

SEQ ID NO: 33731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcatgttgcgtttgcatgtatgtagcgta

SEQ ID NO: 33732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcattgtggatgctcgctcctcaaaactc

SEQ ID NO: 33733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcccagagggtacccctgtgatacgatag

SEQ ID NO: 33734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctccccgagtgtcgatcaagaggccgtgtc

SEQ ID NO: 33735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctccctctagcggcgcaatcctcgctacat

SEQ ID NO: 33736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctccctgattgtgtcatgagttagttaagt

SEQ ID NO: 33737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcccttgtgacagtattgagcctgtatac

SEQ ID NO: 33738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctccgatgtattcgctcgcgcctgctgtct

SEQ ID NO: 33739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctccgccctgtcactgaagaattacataac

SEQ ID NO: 33740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctccgttatcgattacaataaagctaattt

SEQ ID NO: 33741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcctatcagatgaattggagttaaggtgc

SEQ ID NO: 33742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcctcggtgacgatgctgcgggattcatg

SEQ ID NO: 33743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcgacagcgagggtttcttgcttatatgt

SEQ ID NO: 33744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcgaccgcatcaattggttccggtgtatc

SEQ ID NO: 33745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcgacgtttcatcgctaacgcgtgcaccc

SEQ ID NO: 33746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcgcaattgtgactataaccatagcaccg

SEQ ID NO: 33747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcgcactttatggtcctgcactagaagaa

SEQ ID NO: 33748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcgcgtgacatctagattggtggacttag

SEQ ID NO: 33749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcgcttccgactcgtccgcggtttatttc

SEQ ID NO: 33750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcgggcttttgctaaatgtcttttcaatg

SEQ ID NO: 33751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcggtcacagagtggacacacctcgtatt

SEQ ID NO: 33752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcgtaaggtcggaaccaaggtagtccgga

SEQ ID NO: 33753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcgtcccgcatcatatgagtttagttgca

SEQ ID NO: 33754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcgtgtacttgtatcgcatctcttaggtc

SEQ ID NO: 33755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcgttgccgctgaccattgtcccttgatc

SEQ ID NO: 33756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcgttttacatgttcctccaccagagcgg

SEQ ID NO: 33757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctctagtatcctcgcctaacgtgtaaatgc

SEQ ID NO: 33758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctctatgcgggcgggacgttcgcgaatcat

SEQ ID NO: 33759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctctcaaggcgcttgcggggcatcaaacat

SEQ ID NO: 33760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctctccgcggtaatttgcttggctcgcagg

SEQ ID NO: 33761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctctccgtgagctgctaataccctaggttt

SEQ ID NO: 33762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctctcgtttgtcagtctgccctccgctcat

SEQ ID NO: 33763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctctctacgactagcacgacatcgcttttt

SEQ ID NO: 33764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctctggccgaaacttcgggaacgcagatcg

SEQ ID NO: 33765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctctgtggatcattgttcatacggcaccgt

SEQ ID NO: 33766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctcttaggaattcgttaggggcgtctgtct

SEQ ID NO: 33767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctctttagaatccaggtgttcagaacccgc

SEQ ID NO: 33768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgaaccgtacggtcctgcctctggacagc

SEQ ID NO: 33769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgaacgctttcgcatgatgctgtggtgat

SEQ ID NO: 33770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgaatggcagcgaagcggggatctatgca

SEQ ID NO: 33771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgaattcttcgctcaaagcttctttgtgg

SEQ ID NO: 33772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgacacagaatctcggtatgtaggcgctg

SEQ ID NO: 33773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgaccaggactcaatttgagctttgggaa

SEQ ID NO: 33774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgaccgctttggtaggaatgtgcgacgcg

SEQ ID NO: 33775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgacgactatgcgctcgtggtctgctgaa

SEQ ID NO: 33776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgactctttgtaccccacgaatatggagg

SEQ ID NO: 33777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgactggcactggccacgtttggatcgga

SEQ ID NO: 33778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgactttgctgttcatatcgggccggcat

SEQ ID NO: 33779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgagcaggctgaaaagccgatccttcccg

SEQ ID NO: 33780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgaggctataacgattcacgcatcttggt

SEQ ID NO: 33781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgagggaaacaacaaagttgaagatcgga

SEQ ID NO: 33782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgagtgttcggcttcgggtctcgtctggg

SEQ ID NO: 33783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgatatcgagcgtgtggccgtagtgtcca

SEQ ID NO: 33784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgatcggtttctgatggggtttttgccgt

SEQ ID NO: 33785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgatcgtcgttcgtctaccttcgtattgc

SEQ ID NO: 33786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgatcgtggctaacattggccatactagc

SEQ ID NO: 33787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgatgtgtttgggatcactgactgcgcca

SEQ ID NO: 33788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgattagttctcggactcgatggtcaaga

SEQ ID NO: 33789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgattcacgtaaggccggacgctctctta

SEQ ID NO: 33790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgcaaacgattattaaggacatttacatt

SEQ ID NO: 33791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgcaaacgtggcaaccaaaggattggagg

SEQ ID NO: 33792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgcaaatgacccccaccattccaggcgtc

SEQ ID NO: 33793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgcaagttccagtcgagctagtcccaggc

SEQ ID NO: 33794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgcacattcgtcggtggtactcatgtccc

SEQ ID NO: 33795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgccacgggatttcgcacacgtattgctg

SEQ ID NO: 33796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgcccatttctaaatttgcaccagctccc

SEQ ID NO: 33797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgccgccgtggcaatgaggacataccgac

SEQ ID NO: 33798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgccttgagggccagcccgtcccttgagc

SEQ ID NO: 33799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgcgcccgggactgctcttaaattccccc

SEQ ID NO: 33800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgcgctcgtgttagggcactcagttccgg

SEQ ID NO: 33801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgcgctttcaatagtatttgtatgtcgcg

SEQ ID NO: 33802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgcggacgtggtctgaaaaaatgatgcgt

SEQ ID NO: 33803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgcggattgcctggttgaactacgcgggt

SEQ ID NO: 33804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgcggtggagttgtgattctgagagccgc

SEQ ID NO: 33805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgcggttctcgggcgtcgcgtttttcctg

SEQ ID NO: 33806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgcgtccatgtgttgcacccgtgtgaacg

SEQ ID NO: 33807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgcgtgtgcctgacctttgaactttcctt

SEQ ID NO: 33808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgcgttgtgtcttgcttgatatcttttgg

SEQ ID NO: 33809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgcgtttgtcacacttcccaaagcttcgt

SEQ ID NO: 33810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgctatctcaggcgctgattaccaaggtt

SEQ ID NO: 33811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgcttatcggctgcctcgaaacgcgtact

SEQ ID NO: 33812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctggaaccattgctactacgtttgctgact

SEQ ID NO: 33813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctggaacgttaccccaacatctaactaata

SEQ ID NO: 33814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctggaatccgagggcgataatccgcgcagc

SEQ ID NO: 33815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctggacaccaggacagagggggcccataat

SEQ ID NO: 33816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctggacagtgtcatttgactgctggaacat

SEQ ID NO: 33817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctggattgcccgttattgctcctccgccgt

SEQ ID NO: 33818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctggcagtgcgccagacaacatttgtctga

SEQ ID NO: 33819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctggccatctgggataggttcgccccaagg

SEQ ID NO: 33820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctggcgtacggacagggcttcaacgtagtc

SEQ ID NO: 33821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgggacagttgagtaggttgacctcagcc

SEQ ID NO: 33822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgggcgcagttcgcgggacgcagacggtg

SEQ ID NO: 33823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgggctttttgtttctttgatgttacttg

SEQ ID NO: 33824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgggtacgaattgggtcaaacacgtgata

SEQ ID NO: 33825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgggtcggcgttatacactcggccggttg

SEQ ID NO: 33826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgggtgaagggggtggaggggacgtcaag

SEQ ID NO: 33827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgggttacaagtccatgttactttgttgg

SEQ ID NO: 33828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctggtatttccggattgatgtttgccattc

SEQ ID NO: 33829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctggttaggggtatctgaacgcgtcaggag

SEQ ID NO: 33830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgtaaaacaactcttgcgcttgaaaccgt

SEQ ID NO: 33831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgtagtagttattgcgacggcggttcgtg

SEQ ID NO: 33832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgtataggacatgcagacccaccattccc

SEQ ID NO: 33833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgtattatcagatcttgacggctttgcgc

SEQ ID NO: 33834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgtcatcgtatatgagaacgcaaaatggg

SEQ ID NO: 33835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgtcattaccaccggagtaatttggtaag

SEQ ID NO: 33836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgtcggcttcactagggcttgttggcgct

SEQ ID NO: 33837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgtcgtctgtttaggtgccgtgtgcatgc

SEQ ID NO: 33838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgtctattccagttcgccgttaactgatc

SEQ ID NO: 33839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgtctgggaccccggcatcttgagaactc

SEQ ID NO: 33840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgtctttgcgggtcttcatctgctagttt

SEQ ID NO: 33841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgtgcaatgggtggcaagacgacaagcgg

SEQ ID NO: 33842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgtgccagtcgttcttcttcgtaggaagg

SEQ ID NO: 33843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgtggcagaattacgctaatatgatttgc

SEQ ID NO: 33844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgtgtcggggtgaaccattgaccgcgtgc

SEQ ID NO: 33845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgtgtctgcggataggtgtggcctccgaa

SEQ ID NO: 33846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgtgttacgtgcactaaaatggaagagta

SEQ ID NO: 33847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgtgttcgttcaaatgaaaatccgtctcc

SEQ ID NO: 33848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctgttggcgtcaacccaggtataggcttta

SEQ ID NO: 33849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttaactaaactgtggaattctttttacgc

SEQ ID NO: 33850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttacgaaagaggattatttgatcacttgt

SEQ ID NO: 33851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttactggtgcttgccctaacacagctttc

SEQ ID NO: 33852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttagacaaaaaaattactatccctctggg

SEQ ID NO: 33853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttagaggcccattggaacaacaacgccca

SEQ ID NO: 33854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttatgtctatggtggtgcttacatattgc

SEQ ID NO: 33855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttcaccctccgtgcaatcacaagagtaca

SEQ ID NO: 33856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttcacgggtgctctgctacggtatggacg

SEQ ID NO: 33857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttcacgttcaggagaaattacgcctggtg

SEQ ID NO: 33858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttcagactgcaccagttgtgtggatgtgc

SEQ ID NO: 33859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttccacactgttattcgaggttttgttac

SEQ ID NO: 33860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttccatcctaacccccaggaagacctcac

SEQ ID NO: 33861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttcccaaggattgttgggtttcggccttc

SEQ ID NO: 33862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttcccaccaggcaacgtgaacatgtcagc

SEQ ID NO: 33863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttccccagtcggtcgggcggggtaaatct

SEQ ID NO: 33864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttccccgttactgtcgtgtgcctctgcgt

SEQ ID NO: 33865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttccttttatggtggcacttccaactggt

SEQ ID NO: 33866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttcgcgttcgggccgagctcgaaaggtgc

SEQ ID NO: 33867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttcgggttacatgcgatggtgcgtaaggc

SEQ ID NO: 33868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttcgggttactataccttagccggaggtt

SEQ ID NO: 33869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttctacgttggttccggtccgttgtggcc

SEQ ID NO: 33870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttcttcgggggaacgccgtcgtcgaaacg

SEQ ID NO: 33871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttgaggggctcggtttagttgtttcattc

SEQ ID NO: 33872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttgaggttatggggactggatgtcgtcca

SEQ ID NO: 33873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttgagtgctcggaattagtggttaccaca

SEQ ID NO: 33874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttgcagtatcgttgacactaggcgtaggc

SEQ ID NO: 33875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttgcccgcggatggggacgtatcaccatg

SEQ ID NO: 33876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttgcgagtggaaaaggcgcgaagggggaa

SEQ ID NO: 33877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttgcgatcttatcacctcggttttatcta

SEQ ID NO: 33878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttgcttcgaacaggcgaccggtgtaggag

SEQ ID NO: 33879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttggacatcaggtaggccctccacggtgt

SEQ ID NO: 33880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttggatatgtcagtatcgtagttcgttga

SEQ ID NO: 33881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttggcactactttcgtctatcatcgcggc

SEQ ID NO: 33882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttgggagtcaccgagatactccgttggtg

SEQ ID NO: 33883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttggtgggggcctttttcaggtccggtct

SEQ ID NO: 33884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttggttttcgatttagggaattgttgtgt

SEQ ID NO: 33885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttgtgctttttaacaaggtcagtggtctg

SEQ ID NO: 33886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttgtttaattcatctgcctgcatcccgtt

SEQ ID NO: 33887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctttaactaacggagcatcctccttagccg

SEQ ID NO: 33888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctttaggacgtactgccagaggatgtgacg

SEQ ID NO: 33889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctttatggaacatgggatatcatccgaggt

SEQ ID NO: 33890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctttcgagaggactcatgggtgcggttcgc

SEQ ID NO: 33891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctttcgcctgagggcgctagggggaccaaa

SEQ ID NO: 33892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctttgcatggaatacacatgacgcgcgagg

SEQ ID NO: 33893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctttgcatttgctcgcagcgggaaaggtcc

SEQ ID NO: 33894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctttgcgtccacatgacttgttgatgttgc

SEQ ID NO: 33895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctttgttgcttaagtggaccagcgcgatgg

SEQ ID NO: 33896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctttgtttgtcctgacactcatcgcgacct

SEQ ID NO: 33897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttttaccctcctgtgtgtggacggaagag

SEQ ID NO: 33898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttttatggtagtcggtgtggccctgaaaa

SEQ ID NO: 33899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttttcgtccttaagtcggtgctgacccta

SEQ ID NO: 33900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctctttttgcgggtgacggcattttggggcac

SEQ ID NO: 33901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctcttttttgggcgtcgtgtgccacgaagccg

SEQ ID NO: 33902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaaaatgtgcaatctcattgctgcagcggt

SEQ ID NO: 33903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaaacgtggattaccggcgccccacgggta

SEQ ID NO: 33904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaaactcctccaacttacgtctcttcccat

SEQ ID NO: 33905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaaagatctaagacctttagtgcaaagacg

SEQ ID NO: 33906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaaagggggacaaattaccatcacggtgta

SEQ ID NO: 33907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaaagtcctgcttaatagataagtcaccgt

SEQ ID NO: 33908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaaagtggcacttcgtcgatatccatgcga

SEQ ID NO: 33909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaaagtggcgtgaggggtttgcgacatccg

SEQ ID NO: 33910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaaagttgaaagccgcctagggctttcctt

SEQ ID NO: 33911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaaatacttcggattcaatgggtgcgttcg

SEQ ID NO: 33912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaaatggattgactcgttcacaaccattag

SEQ ID NO: 33913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaaatgtattttgctgacctacctctcggc

SEQ ID NO: 33914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaacatacctagacatacggcccttgaccc

SEQ ID NO: 33915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaacatacgctgcactgtgtttgggacgca

SEQ ID NO: 33916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaacgccatttatccaaaattgggttagcg

SEQ ID NO: 33917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaacgctctttagttggtggactgcgctcg

SEQ ID NO: 33918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaacgggctgttatctcccgacgaaaaagc

SEQ ID NO: 33919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaactcaggcctctgtcccggtgtcgctcg

SEQ ID NO: 33920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaactggccgctacagttctcggtgaaatc

SEQ ID NO: 33921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaagaaatgggaaattgccttttatcttgc

SEQ ID NO: 33922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaagagtgaagaccgtctgaagggcatagg

SEQ ID NO: 33923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaagatcgtataagagttgctagctcatct

SEQ ID NO: 33924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaagatctagtttaaggtctggaacaaggt

SEQ ID NO: 33925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaagatgcgttgatacctccctgaccactc

SEQ ID NO: 33926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaagatgctgcggctctcgaattacctgca

SEQ ID NO: 33927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaagcccatatcggcgagtacgacgtatta

SEQ ID NO: 33928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaagcgcataagtagggcctgtacaatgcg

SEQ ID NO: 33929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaagcggtgatgttgcacaaggtgtaggtc

SEQ ID NO: 33930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaagcgtgcaatgcacgtgcgtgcatccat

SEQ ID NO: 33931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaagctcacacgccccactggtgtcctcac

SEQ ID NO: 33932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaagctggcgtctggacggagctgctcagg

SEQ ID NO: 33933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaaggacctactgacaaaggatattgagta

SEQ ID NO: 33934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaaggatgcaaaccctgtaggtcaagcgtt

SEQ ID NO: 33935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaaggtgcgcgatacaaacgcttggccggg

SEQ ID NO: 33936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaagtggtcgggttcctaagtcatcaaaga

SEQ ID NO: 33937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaagtgtctttacgtccgtgaggtcggatg

SEQ ID NO: 33938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaagttccgtgcactcggatcctggggtac

SEQ ID NO: 33939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaatatggtgtggtgttcagatgctattgg

SEQ ID NO: 33940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaatattctgcgtttttgcttgcttcttcg

SEQ ID NO: 33941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaatccgcccgtcgcatccggtgggaagtg

SEQ ID NO: 33942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaatcgctaaccgtcgagtttgccgcttgg

SEQ ID NO: 33943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaatcgggcagtccgttgctttggcgctaa

SEQ ID NO: 33944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaatcgggtggagctaaaggagcgataacg

SEQ ID NO: 33945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaatcgtaacttcttaagtagtcattagac

SEQ ID NO: 33946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaatcgttaatgggtcgtcgctgcatgttc

SEQ ID NO: 33947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaatctctgggcgaactattcgatgacgga

SEQ ID NO: 33948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaatgacgacgcgcatggcctctagctggg

SEQ ID NO: 33949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaatgatgcattaaaccggccattcgggac

SEQ ID NO: 33950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaatgcttgctcgtgctcgggccagcgggt

SEQ ID NO: 33951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaatggcattctaactgaccgcctagggca

SEQ ID NO: 33952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaattgaagccctcgaatgtgtatttcggc

SEQ ID NO: 33953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaattgaccacgacatcaagttcattctgc

SEQ ID NO: 33954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaattggagagacaactgcgctaaagcaga

SEQ ID NO: 33955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaatttatgtctgcagtttacggctctagc

SEQ ID NO: 33956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaatttttcgcacttacgtattatcagccg

SEQ ID NO: 33957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacaaggatgtattcgataggatccctcgc

SEQ ID NO: 33958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacaagtcccgctgcaatgtatgtgtaact

SEQ ID NO: 33959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacacgcccggacatacatcctcttggttt

SEQ ID NO: 33960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacacgcttagaaggaacacagccctcgta

SEQ ID NO: 33961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacacggaggtagcgtactggacgttatac

SEQ ID NO: 33962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacacgggtaacgaactgaaaaaagtgagt

SEQ ID NO: 33963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacacggtgcccgacttgtgctgatgtagg

SEQ ID NO: 33964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacacgttccttattcaagcacaattactg

SEQ ID NO: 33965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacactactgattgtgttctttcgcaggag

SEQ ID NO: 33966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacagaaaggtttagaatcctgggcgtccc

SEQ ID NO: 33967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacagaaagtgaggccttctgctaactctc

SEQ ID NO: 33968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacagaggtgcacgccgtgtaagtgagggg

SEQ ID NO: 33969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacagcatacggtagctttgtcttgaatgc

SEQ ID NO: 33970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacagcgtaacaccgacttgggatctgagt

SEQ ID NO: 33971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacaggaattgttacacatgggtgcacggc

SEQ ID NO: 33972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacaggcaatgccgatacgtacaccttttc

SEQ ID NO: 33973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacagtagtccagcttgttttgttatgacg

SEQ ID NO: 33974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacagtgagccttgcacgtatccccggatc

SEQ ID NO: 33975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacatatctggttaaatagtgtcgtcgcgg

SEQ ID NO: 33976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacatccgcaaccttaaccggccttgcttg

SEQ ID NO: 33977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacatctgatcagtgcaacggaactacatt

SEQ ID NO: 33978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacatgatcgagtccatacatgttgtagga

SEQ ID NO: 33979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaccacaccttggtacgatgttcggctcac

SEQ ID NO: 33980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaccaccacggagtggatctaacttgcatg

SEQ ID NO: 33981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaccacggcgctcgcaatcatggcgggtac

SEQ ID NO: 33982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaccaggctgtctactctcaaagccttgct

SEQ ID NO: 33983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacccagtagttccaccatgatcttggggg

SEQ ID NO: 33984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacccgtaagtcatcgattgggttgcgcgt

SEQ ID NO: 33985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaccctggcccctgactccttagtgcgggc

SEQ ID NO: 33986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaccctttgcagcatcgaccttttataggc

SEQ ID NO: 33987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaccgaacgccggctatagccttcgcatct

SEQ ID NO: 33988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaccgactttctgcgcacacccgtttccac

SEQ ID NO: 33989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaccgatgtccgagttgaggccagctgcgg

SEQ ID NO: 33990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaccgcaggatccgagttttgtggggcgtg

SEQ ID NO: 33991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaccgccgaattatgctcgtatggcgtggg

SEQ ID NO: 33992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaccgcctcgtgctgtgtaattctacgccc

SEQ ID NO: 33993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaccgtgacattgttctacatgctggcgcg

SEQ ID NO: 33994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaccgtttgattcggtttggaggtttcccg

SEQ ID NO: 33995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacctggtgcggcagaggaacatttggccg

SEQ ID NO: 33996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacgaatctgtgcgtatatttatgactatg

SEQ ID NO: 33997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacgacacgcgatggcccctggggtcacct

SEQ ID NO: 33998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacgaccacatcacgcggcgcttcttccgt

SEQ ID NO: 33999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacgacgcaggatcatatccgggatgggtg

SEQ ID NO: 34000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacgagtaacgacccattattccgagtttt

SEQ ID NO: 34001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacgagttgctatagcgaaggtccggtcga

SEQ ID NO: 34002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacgatagcgctcgaagttacctgcgggcg

SEQ ID NO: 34003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacggatatcttcggcggtactttacacgt

SEQ ID NO: 34004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacggcccggctttgatcatcgccacgtct

SEQ ID NO: 34005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacggtggttgcacgggtctgtggtgggat

SEQ ID NO: 34006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacgtccgtggttagttgatgtcggtggta

SEQ ID NO: 34007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacgtcttttacacctctgttaaacaattc

SEQ ID NO: 34008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacgtgagagcgatctccgactattccctc

SEQ ID NO: 34009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacgtggaggcggagatagtgtcgcttacc

SEQ ID NO: 34010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacgtggaggctgagcgtggatagggcctt

SEQ ID NO: 34011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacgtggccacgggtttcatcggtcccccg

SEQ ID NO: 34012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacgttcttgaccaaaactgatgttggatt

SEQ ID NO: 34013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgactacgatcacaccacgcgatcctagtgt

SEQ ID NO: 34014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgactcatcccgtgattataccctgctggat

SEQ ID NO: 34015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgactcgtgctgtcaaaagcctgggtgcatc

SEQ ID NO: 34016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgactcttatgcgcttgtaacaaaggtctca

SEQ ID NO: 34017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgactgaacttaggggactctatgctctcgg

SEQ ID NO: 34018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgactgatagccggctaggtcgtacttttcc

SEQ ID NO: 34019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgactgcgggacgtcggagttcaacttcgtc

SEQ ID NO: 34020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgactgctatgctgctccgaacaaagcgctg

SEQ ID NO: 34021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgactggtttgatcgcacatgactctattcc

SEQ ID NO: 34022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgactgtgcatctttgacaaatgttccggaa

SEQ ID NO: 34023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgactgtgtctggccggtgttgggatccagg

SEQ ID NO: 34024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgacttgtgtttgattcgctgcgtttgtgct

SEQ ID NO: 34025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagaactgtgctagtgttagtactgtgccc

SEQ ID NO: 34026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagaccccgtgcgattatagttgtttaggt

SEQ ID NO: 34027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagacctgtgttggcccgacatgcacagtg

SEQ ID NO: 34028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagactctctacaccagctgggagcgtgtg

SEQ ID NO: 34029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagcaacgtaatgcaagaagttctttgggt

SEQ ID NO: 34030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagcagtaggtgagcacccagcaggggacc

SEQ ID NO: 34031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagcatggtgtagtctccggtgatcggggc

SEQ ID NO: 34032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagcctcactgggcattaattgtcggcgag

SEQ ID NO: 34033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagcctgtattcatcccccggggtgtgcgt

SEQ ID NO: 34034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagccttggagggcccccatcgattacagg

SEQ ID NO: 34035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagcggattggattatgatcattcccggat

SEQ ID NO: 34036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagcgggattctgttcctccgtcccttctt

SEQ ID NO: 34037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagcggtacgctaacagtaatgtacacacg

SEQ ID NO: 34038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagcgtagttgactattcctgggcctgtgc

SEQ ID NO: 34039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagcgtcggtttagtgattcatgagctttg

SEQ ID NO: 34040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagctaaaggcccagttggcttggacggct

SEQ ID NO: 34041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggaaccgccggacgccgaccaaatgacg

SEQ ID NO: 34042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggaccacgccgttaggaaagccgaatcc

SEQ ID NO: 34043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggactctaacctcgcgatcacagcgggc

SEQ ID NO: 34044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggagcacggagagtatacttcaggagcc

SEQ ID NO: 34045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggaggggtggtcgttcttcagctcgttc

SEQ ID NO: 34046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggatagcacggcgcccgattgtcactga

SEQ ID NO: 34047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggattaggcatgtgcccgatgtagttgg

SEQ ID NO: 34048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggatttttgagtacggctggctgattgg

SEQ ID NO: 34049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggcacatcgccctctatacgcggactat

SEQ ID NO: 34050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggcctggtttctagtggattggacagca

SEQ ID NO: 34051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggcgaaagctagtagagatagtgtggcg

SEQ ID NO: 34052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggcgcgagatgtggtcttcgtaccgtgt

SEQ ID NO: 34053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagggaatggacgacaactccgggcggttt

SEQ ID NO: 34054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagggactctcaatgggggcgttttgtgaa

SEQ ID NO: 34055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagggctacactgagcagtcgaatagtttg

SEQ ID NO: 34056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggggtcactggcacgctcgctcgcacac

SEQ ID NO: 34057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggggtggacctgggcttcgagcgtcctg

SEQ ID NO: 34058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggtagcaagataaggtttcgccgggtac

SEQ ID NO: 34059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggtagtctgcaaaccaagaacaggtcgt

SEQ ID NO: 34060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggtcaaattcaacttccattcggcgatt

SEQ ID NO: 34061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggtcccacaatggttagggttctcgatt

SEQ ID NO: 34062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggtcgtttattgttttgaaagcgcggcc

SEQ ID NO: 34063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggtgtgcgatagccgtcgggagtagtca

SEQ ID NO: 34064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggtgtggtccaacgatgtgatgcctttc

SEQ ID NO: 34065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgaggtgttgtaggtcaaccaaatcgaatcg

SEQ ID NO: 34066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagtaacactagcactagtggtaccgctag

SEQ ID NO: 34067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagtaatttttcattggatcgttgattgat

SEQ ID NO: 34068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagtacgaattcggcaggtattgtaatagg

SEQ ID NO: 34069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagtacgagcggtttcggtggcggcagggg

SEQ ID NO: 34070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagtcagaatccagaaagtgctgcttcctt

SEQ ID NO: 34071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagtccttcgtttaggctcttgcctcttaa

SEQ ID NO: 34072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagtctgggggtccatgatggttcatttcg

SEQ ID NO: 34073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagtgcctaggatttctttgattctataat

SEQ ID NO: 34074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagtggatgtgcctgtacccggtagcttct

SEQ ID NO: 34075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagtggattgaacaatatgcgcaattgccg

SEQ ID NO: 34076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagtgttacgttggtatgaaggtttacccg

SEQ ID NO: 34077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagttcgaatggcgacgggttaatgctggt

SEQ ID NO: 34078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgagttgacctaccaataatccagagttacg

SEQ ID NO: 34079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgataaatgattggtgttaatgccgcgtctg

SEQ ID NO: 34080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgataacaccgcttgttagcataccagcgtc

SEQ ID NO: 34081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgataacgttcaacggatttgccttgtatgc

SEQ ID NO: 34082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatacaccatacgtccagaaggatctagga

SEQ ID NO: 34083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgataccaacgtgatgacggccgcagggcta

SEQ ID NO: 34084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatacgtttgagctggcgggttccgatgaa

SEQ ID NO: 34085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatagcgtgcggttaaaactcgtaggggat

SEQ ID NO: 34086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatagggcaaacgacgtaggccttggagtt

SEQ ID NO: 34087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatatcaatcttcgtttgtcttcggccagt

SEQ ID NO: 34088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatatgcattgaagtcggagtgtttagtgt

SEQ ID NO: 34089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatcaaccgtatggtatatcccgcagaagg

SEQ ID NO: 34090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatcacaggaggagttggcgataattccgc

SEQ ID NO: 34091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatcacatcccgaagaatgggccgttgcct

SEQ ID NO: 34092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatcaggtacaatgtaggactaggggcgct

SEQ ID NO: 34093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatcatcgcttcatccggagtaaagacgcc

SEQ ID NO: 34094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatcattgaccgtatcctaatttttgggtc

SEQ ID NO: 34095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatccaacatcaccctggaaggccgccggt

SEQ ID NO: 34096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatccactctctcgtaggatacttgggaca

SEQ ID NO: 34097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatccatcaatggcgactaagcaaagatta

SEQ ID NO: 34098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatccgggggtgcggttcttccatgcgagg

SEQ ID NO: 34099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatccgtaaaccgcccgatgtgttttgccc

SEQ ID NO: 34100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatcgatcctcaatcactaggtcgtcttgg

SEQ ID NO: 34101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatcggatggagtagtcagtccgtgcgagc

SEQ ID NO: 34102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatcggtcgttgataggctcagtagttgta

SEQ ID NO: 34103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatcgttcacgttcccttcactcatgttcg

SEQ ID NO: 34104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatctttgcgggcgctatgggctgggttcc

SEQ ID NO: 34105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatgaaaccaatgcgtacaccgccttcgga

SEQ ID NO: 34106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatgaaactgttgggtaaagcactatttcc

SEQ ID NO: 34107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatgaggccgacttaagaccatacgattac

SEQ ID NO: 34108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatgagttcccgttgcaagctgacagggac

SEQ ID NO: 34109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatgcagcctggtcgccttccaggggtggt

SEQ ID NO: 34110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatgcagtggtatactgtcggtggacctag

SEQ ID NO: 34111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatgcatgtccgaggacctacgcgggcgat

SEQ ID NO: 34112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatgccattatgcacacctgtacttcgggg

SEQ ID NO: 34113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatgcgcgtgtggggaccagttctacagcg

SEQ ID NO: 34114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatgcgctcacttattcataacagggccat

SEQ ID NO: 34115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatgctcacattggggtacgtggctaccaa

SEQ ID NO: 34116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatggatggtgggtctctttttgcagggta

SEQ ID NO: 34117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatggattctggacgcggtacgacgagcgt

SEQ ID NO: 34118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatggcaataatgagcacttagcatgcctt

SEQ ID NO: 34119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatggcacgttttattctttgcgcggacat

SEQ ID NO: 34120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatggcggaagctcaatgcccttgcatggc

SEQ ID NO: 34121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatgggatgggtggggtttagagggctgcg

SEQ ID NO: 34122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatggtggcgttggcagaatggcaggttcc

SEQ ID NO: 34123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatgtattgtcaaggtctccttctccttgg

SEQ ID NO: 34124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatgtcagagcattcggccacagcttacgc

SEQ ID NO: 34125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatgtgctgctaagggttcagtgatctcct

SEQ ID NO: 34126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatgtgggagattataatgtcataagacca

SEQ ID NO: 34127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgattaattccaccgtttttttagatcggga

SEQ ID NO: 34128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgattagcgtccatggtcgcatggtattctt

SEQ ID NO: 34129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgattatcatggtttatcccgtacaccgctt

SEQ ID NO: 34130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgattcaaccttgtccgtgagggcttcgcgc

SEQ ID NO: 34131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgattcataatcccccaatttgtagcgccgg

SEQ ID NO: 34132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgattctgtccgagtcttcgctgagttcgct

SEQ ID NO: 34133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgattgagggtgcatggggtcttcttggatc

SEQ ID NO: 34134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgattgcaacttggcccctgagtctccacgc

SEQ ID NO: 34135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgattgcaggaactggctgcgcaaacccttt

SEQ ID NO: 34136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgattggtggaggttcggctccatgttatga

SEQ ID NO: 34137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgattggttgcgtgattttgcgcgcgacctg

SEQ ID NO: 34138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgattgtagcgaacacgttgcagtggtgagg

SEQ ID NO: 34139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgattgtgcagagggggtccgatttctgcta

SEQ ID NO: 34140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatttactttggtgagcattacggtttctc

SEQ ID NO: 34141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgatttatgtcttttcgggcgattgggactt

SEQ ID NO: 34142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgattttccgtgcgttcagggtaccgacctt

SEQ ID NO: 34143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaaaacttccgagcccgaagcaaagtcta

SEQ ID NO: 34144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaaacgtgaataagctagatgggattgct

SEQ ID NO: 34145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaacccagacatctatcgcggtcactata

SEQ ID NO: 34146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaacccgaaacgacataaagggtgtcaaa

SEQ ID NO: 34147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaacctgatccccccgcgtactggaccgg

SEQ ID NO: 34148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaacgcaacgtaggccacaagcatggggg

SEQ ID NO: 34149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaacggtacacacgccatttactgtgcgc

SEQ ID NO: 34150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaacgtgacctctttatggggttgtccat

SEQ ID NO: 34151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaacttacacgcctacacggcaatctggt

SEQ ID NO: 34152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaagcacacgaacgtacaaaagagacaat

SEQ ID NO: 34153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaagcgatagcggcattcccgctacatca

SEQ ID NO: 34154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaagggactcttcgcgtcgtattctctcc

SEQ ID NO: 34155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaaggtgccggggccaggttcacgtaaga

SEQ ID NO: 34156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaatatatccttggaggatcttcggcgga

SEQ ID NO: 34157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaatcgactcctgtctgacactgtcgggg

SEQ ID NO: 34158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaatcgggttacagtactcgctctcgtcg

SEQ ID NO: 34159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaatctgttcagttcatgagttcggtttc

SEQ ID NO: 34160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaatgagaggagtatcgggtgcggcattc

SEQ ID NO: 34161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaatgtcgccgcgcggactcactgatttg

SEQ ID NO: 34162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacaaaaaacttgtggtgcttgatggagt

SEQ ID NO: 34163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacaaaaatatgaccaaatgtctgcaccg

SEQ ID NO: 34164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacaatccacataatcataggatttgttg

SEQ ID NO: 34165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacacagggccaagggtttaatgccgtcc

SEQ ID NO: 34166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacactctatcttcgggatatttgttata

SEQ ID NO: 34167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacagggtcggtttttttcgttcgtacgt

SEQ ID NO: 34168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacatcggaatttgtagatattagggctg

SEQ ID NO: 34169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacattcctgcctaggagcgctggtcttc

SEQ ID NO: 34170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacatttacggatggggaaagtaccgcac

SEQ ID NO: 34171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaccacctggccagctgagaaagccacgc

SEQ ID NO: 34172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacctgttactgtttcagaggttgccgtc

SEQ ID NO: 34173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacgaattaccattgtagtccccacattt

SEQ ID NO: 34174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacgagaatgcatggtagtacgctgtggt

SEQ ID NO: 34175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacgcatcacgagtggaagcaggggcgac

SEQ ID NO: 34176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacgccatattgcctaacgaggtggtctg

SEQ ID NO: 34177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacgcttaccgcattactacgactgggtt

SEQ ID NO: 34178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacggagggttcaaggatgcggtcgatcc

SEQ ID NO: 34179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacggataccggtctcagtagcgagaacc

SEQ ID NO: 34180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacggtcgttgacgggtcccccgggattg

SEQ ID NO: 34181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacgtcggtgcgagttctgagaccaatgc

SEQ ID NO: 34182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcactaaaacgttaccccgttgaacctggg

SEQ ID NO: 34183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcactgcgcgcaacactcttgccgccgatg

SEQ ID NO: 34184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcactggcatatcgtcacagaatgagctgt

SEQ ID NO: 34185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcacttaggttcgaacgttaaatcagagcc

SEQ ID NO: 34186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcactttggggtaacactgcttcctagccg

SEQ ID NO: 34187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcagaaacgttagtaaggtattccaggctg

SEQ ID NO: 34188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcagagcagtgtaggtctcgcctaaccagg

SEQ ID NO: 34189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcagaggccatcagagcaccgtcgtctttg

SEQ ID NO: 34190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcagatgcgacaatcagtctgtcgtcatcg

SEQ ID NO: 34191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcagcagttacggaaatccggaaaggtggg

SEQ ID NO: 34192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcagcatcgccccattacggtcggctatta

SEQ ID NO: 34193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcagcattacacgttaagattgagtttaca

SEQ ID NO: 34194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcagcgctggcgtcgtgtatgtcgttcagg

SEQ ID NO: 34195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcagcggatggttgggagtggtgcctccct

SEQ ID NO: 34196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaggaaatggccgattgttcggtgggccc

SEQ ID NO: 34197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaggcgtctcctttgttctaggtaaactg

SEQ ID NO: 34198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcagggcggtggagtggttcatctctggtg

SEQ ID NO: 34199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcagggctaagagttcatccactcatacgc

SEQ ID NO: 34200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaggtagcggtagccttgtgaagcgagca

SEQ ID NO: 34201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaggtctaacggatggctatttggctccg

SEQ ID NO: 34202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaggtggaagtccgagtccccagtttttt

SEQ ID NO: 34203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcaggttaaggtccaagctgtgcgcgggcg

SEQ ID NO: 34204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcagtaagttccaagctttgtaggaattcg

SEQ ID NO: 34205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcagtcttggttttgctgttagccactttc

SEQ ID NO: 34206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcagtgcataaggcgctgagggcgtccacc

SEQ ID NO: 34207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcagttacacatactaaacagcatagatgc

SEQ ID NO: 34208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcagttcatcggacgttctagtctgggctc

SEQ ID NO: 34209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcataacgcatcataacgggaactttggat

SEQ ID NO: 34210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcataagggatatcctgccataacctacat

SEQ ID NO: 34211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcataatacgatggcccgctgacgttttgg

SEQ ID NO: 34212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcataatgcgttcccatgcccggtcgaggt

SEQ ID NO: 34213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcatcaaactgcacattggttcaacaggat

SEQ ID NO: 34214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcatcaatcctttgcccctatggtaagagc

SEQ ID NO: 34215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcatcatgtttaaccgcggctctggatccg

SEQ ID NO: 34216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcatccactcctcctgtgtgcgttaggttg

SEQ ID NO: 34217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcatccccgggagaagtggtcggttgactg

SEQ ID NO: 34218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcatcctccgctcggcgcacccggtgtgta

SEQ ID NO: 34219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcatcggatggatcttacgtctgcgtgccg

SEQ ID NO: 34220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcatcgggcccttgaaatcgatcgtgggtt

SEQ ID NO: 34221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcatcttattaaacagtggtgcgaccgaac

SEQ ID NO: 34222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcatgccaccaggaatccagctcgggatgt

SEQ ID NO: 34223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcatgcccgtagaatggcgatcgtacctct

SEQ ID NO: 34224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcatgggcacgcatacaccgggcgttgttc

SEQ ID NO: 34225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcatggttacattcggaaaaggagttaagt

SEQ ID NO: 34226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcattactgagtcctccgttgcatgagcgc

SEQ ID NO: 34227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcattattgctgacaaacgaggcgatcaaa

SEQ ID NO: 34228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcattatttgcgatggtacgtttggtcggc

SEQ ID NO: 34229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcatttagttgttgcatgaaaaggtgttat

SEQ ID NO: 34230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcatttgcgcagattgtactgtcatgtggg

SEQ ID NO: 34231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccaaatttggatggctacaatagagataa

SEQ ID NO: 34232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccaaccgttattccttgggcatcgcctga

SEQ ID NO: 34233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccaatttccggcgcccagtccactactac

SEQ ID NO: 34234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccaccgcctcgacatcaatcctatgttca

SEQ ID NO: 34235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccacctaggggttatgagcatggacaatg

SEQ ID NO: 34236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccactatcaattccccctgccctacgatc

SEQ ID NO: 34237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccactctggagttttgcggtgagatctcg

SEQ ID NO: 34238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccactgtttcaatactcggtgcatccaaa

SEQ ID NO: 34239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccagacgactcgttggaacgccttgcaat

SEQ ID NO: 34240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccagactagttacggcttcggcaggcaag

SEQ ID NO: 34241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccaggatggagcattcgggttgattaggg

SEQ ID NO: 34242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccatacgaacacaggtcgatacactgctg

SEQ ID NO: 34243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccatagcgtgagctggtaagtactaccct

SEQ ID NO: 34244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccatcacattaaaatcctgcgcgacatgt

SEQ ID NO: 34245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccatctctggcgcggttttacctcttacg

SEQ ID NO: 34246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccatcttccccgatgctcgaaaattttgt

SEQ ID NO: 34247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccatcttttgcaacggacttctgggtgct

SEQ ID NO: 34248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccatggtttttagaatcaagtgtcttctg

SEQ ID NO: 34249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcccaaacgaccgattttcatcgtttacga

SEQ ID NO: 34250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcccacaatgcgttatggtgacggctctaa

SEQ ID NO: 34251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcccacaatggtgcggctaattgccctggc

SEQ ID NO: 34252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcccatactagtccttgggtcaaaactcac

SEQ ID NO: 34253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccccagtgacccgcgaaaccgtttcgttt

SEQ ID NO: 34254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccccctcccgtttctcgatctagtgcggg

SEQ ID NO: 34255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcccctatgagctgtctgaggtgcccttcg

SEQ ID NO: 34256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccccttaactcgttaatactcgggactgc

SEQ ID NO: 34257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcccctttagttttagtgtgtatgcattcg

SEQ ID NO: 34258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcccgcgacaatggagcttaggcattgtgg

SEQ ID NO: 34259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcccggcgatgattcttgtcaatgagacgg

SEQ ID NO: 34260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcccggtgcactagaagcggggtcgatggg

SEQ ID NO: 34261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccctacggaagacaaaagcgatatacgtc

SEQ ID NO: 34262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccctagggaatagagtgcttaatcctgtg

SEQ ID NO: 34263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccctcgcttagttcacgcgtaccggggcc

SEQ ID NO: 34264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccctcggatctcctctttcgtgtctagct

SEQ ID NO: 34265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccctgaactgtaagtctggcgagtcgctg

SEQ ID NO: 34266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccctgctcgtatgatccgtcgccgatgca

SEQ ID NO: 34267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccctggaacggaccatcccatagtgtcgg

SEQ ID NO: 34268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcccttcctgcattacattcggtggaacct

SEQ ID NO: 34269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcccttgactcgcgactagagttctagcac

SEQ ID NO: 34270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccctttgagcttccattccaatgacctca

SEQ ID NO: 34271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccgacagagttgtgctttgcatcgtactt

SEQ ID NO: 34272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccgactacaacgcagttagggcaaggggg

SEQ ID NO: 34273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccgaggctgtattacggggttcgtgcgta

SEQ ID NO: 34274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccgaggtacggttggtggacgaaggtata

SEQ ID NO: 34275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccgagtgggatagggcgtggacatgctgt

SEQ ID NO: 34276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccgcaacggtatcggcgatcgagccactc

SEQ ID NO: 34277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccgcagggggtgatttggggaacggcctc

SEQ ID NO: 34278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccgcattgtttgcagtttcgaaccgtgag

SEQ ID NO: 34279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccgcgcggtgcaggatgcctaaggaccaa

SEQ ID NO: 34280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccgcgtacagtacgggaagtatggcgtgc

SEQ ID NO: 34281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccgcgttcttcaggtgctaactcccaagt

SEQ ID NO: 34282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccggaaataagtcagcggacgggttcatc

SEQ ID NO: 34283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccggcagggagctgaaaagcatacaggac

SEQ ID NO: 34284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccggggtgagggcatctatggtggacgga

SEQ ID NO: 34285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccgggtagcaagcgggatactacgcgatg

SEQ ID NO: 34286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccgtcccgaaggtgtctaggatcccgagc

SEQ ID NO: 34287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccgtgcgaaattatgagaactttaacgct

SEQ ID NO: 34288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccgtgtcgttacccagtgtgcagcggtcg

SEQ ID NO: 34289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccgttatggtatgcatgcgtcctttttac

SEQ ID NO: 34290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccgttgcctggtgcagagttggacgcctg

SEQ ID NO: 34291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccgttttgccagatcagtttttttgctct

SEQ ID NO: 34292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctaacctgccgctttgttagaagtgaga

SEQ ID NO: 34293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctacccacgaaacgctaagttccagatt

SEQ ID NO: 34294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctacgaggctaatatccacgttgtggta

SEQ ID NO: 34295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctcatcgttagttcgagatttaacgctt

SEQ ID NO: 34296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctcgcgcggtcatgttacgcgaacgccc

SEQ ID NO: 34297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctcgcgtaggatatgctagacacaggtt

SEQ ID NO: 34298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctcgctgcaggcttaagctatagaatct

SEQ ID NO: 34299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctcggacatatatgctatctttgaacat

SEQ ID NO: 34300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctcggcacggtccggtcctcgctgttgc

SEQ ID NO: 34301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctcgtaggagctgtgtatcctaaaggcg

SEQ ID NO: 34302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctcttcgggatctatcctaacgctattg

SEQ ID NO: 34303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctgacgcatctatcagctgtcgggcgag

SEQ ID NO: 34304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctgaggttgaaggactctcgtttgacca

SEQ ID NO: 34305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctgcagagagtcgttgcttggaaggccg

SEQ ID NO: 34306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctgctcgtttgataggaaggtatagcac

SEQ ID NO: 34307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctggcattggacgggtgggagtgtaggg

SEQ ID NO: 34308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctggctgggcttgaacaacttaggcggt

SEQ ID NO: 34309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctgggaaccaaatcgcgaaccgacgccc

SEQ ID NO: 34310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctggtggtcttcactggctctttaggga

SEQ ID NO: 34311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctgtgctatggtctttcatccctccttc

SEQ ID NO: 34312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctgttgtcaatgagaccgcgacgcgagt

SEQ ID NO: 34313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccttcagcgcccatgcttagctttcgata

SEQ ID NO: 34314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccttcccacgttctacctatttcggcggc

SEQ ID NO: 34315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccttggatcccggtcggtaaccacatgtt

SEQ ID NO: 34316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgccttgtatgcttagtcgcgatgctccggg

SEQ ID NO: 34317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctttactttgtgccgtccgacagcccgg

SEQ ID NO: 34318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcctttccgtggtcatggtagtagggcgct

SEQ ID NO: 34319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgaaatggtcgtggctatctttgggtgga

SEQ ID NO: 34320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgaacacggagggcaaatatccggttgtg

SEQ ID NO: 34321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgaacgacgtcactaatttggcgtttcgt

SEQ ID NO: 34322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgaacttaatagcagtgtgggcggaatac

SEQ ID NO: 34323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgaaggtatcagcgtcgaatcacgattcc

SEQ ID NO: 34324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgaagtcctccagagtttacagtgacgta

SEQ ID NO: 34325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgaagttcgctcctcgttgtgaacctgtc

SEQ ID NO: 34326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgaattgctggcatccataaatcggcgga

SEQ ID NO: 34327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgacataatccgtgcaggcccggatgagg

SEQ ID NO: 34328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgaccagatctaaatgtgatatatcgggg

SEQ ID NO: 34329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgacccgttcccgattcacctagctgttt

SEQ ID NO: 34330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgacctcccctcaccgtacagcgaaacct

SEQ ID NO: 34331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgacgaggtcctcatataagttccggggc

SEQ ID NO: 34332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgacgcaaacttgtctgtaaacctggtgc

SEQ ID NO: 34333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgacgcgacgttagaacgcgggaattcct

SEQ ID NO: 34334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgacggaggtctaccaccgaaccctgtta

SEQ ID NO: 34335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgactcggtggaagcgtgacacttcctcg

SEQ ID NO: 34336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgactgaagggtatccatgacgctgtcgt

SEQ ID NO: 34337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgactgcgacctacacactgtcccgatca

SEQ ID NO: 34338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgagactttgaactcattgcgcgagcagt

SEQ ID NO: 34339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgagattctgtaatccgattctatcctat

SEQ ID NO: 34340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgagccgggagggtggcacatggcaatca

SEQ ID NO: 34341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgaggacattgacggaataaagcttgggg

SEQ ID NO: 34342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgaggactcgacgtggtacggtttcgacg

SEQ ID NO: 34343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgagtggcacttcatggagttgttgggag

SEQ ID NO: 34344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgagtgtcgctggccgacgcatggtggac

SEQ ID NO: 34345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgataacagcacaagcacccccctgatct

SEQ ID NO: 34346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgatagttatatatggcctgagacatgtt

SEQ ID NO: 34347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgatatagcacggtgatcaaggagtatac

SEQ ID NO: 34348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgatatagttgcgttatgactgtgggggg

SEQ ID NO: 34349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgatcaggccctatatatccccatacacg

SEQ ID NO: 34350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgatcgacatcctacacctatcgactcgg

SEQ ID NO: 34351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgatctgacgtgagcctgatccaaaagag

SEQ ID NO: 34352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgattaaatgcccggactgtgcggtatga

SEQ ID NO: 34353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgattatggaggcatggaggcactggtac

SEQ ID NO: 34354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgcacacaagtcaacacccagtgatgggg

SEQ ID NO: 34355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgcaccgccgctggaattgtgtccttgcg

SEQ ID NO: 34356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgcactggtgcccctccagtttccgttcg

SEQ ID NO: 34357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgccaagctgaacatgcgatatcctgtgg

SEQ ID NO: 34358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgccaggaaaacagggacggctccctggg

SEQ ID NO: 34359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgcgacttcgcttctccattgttattctt

SEQ ID NO: 34360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgcgattccagacgcaagttagatgcacc

SEQ ID NO: 34361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgcgcaatggctatcaggcctttttatac

SEQ ID NO: 34362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgcgcgtggacagaggatggtcgtataag

SEQ ID NO: 34363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgcgtagttgcactggggcaattccccgt

SEQ ID NO: 34364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgcgtcaggtgccctgctacaccccgtgt

SEQ ID NO: 34365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgcgtcctccccatttcgttatctggcgg

SEQ ID NO: 34366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgcgttcttcatgttgtaggctgtggacc

SEQ ID NO: 34367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgcgttgagactatgtcccatgttggcgc

SEQ ID NO: 34368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgctctgcaagttcgaggttgttccaacg

SEQ ID NO: 34369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgctgtcagcacctttgtccgcgtatggc

SEQ ID NO: 34370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgctttgttacatgtttaggcccgacgtg

SEQ ID NO: 34371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggaacacaggtgacaagcattcatgcgt

SEQ ID NO: 34372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggagggacggtgtccggcggcctcgatc

SEQ ID NO: 34373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggagtcggggtattgtagctgtagcccg

SEQ ID NO: 34374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggccactggcatcccgtcgctttctggc

SEQ ID NO: 34375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggccctgctagtcgcttttttgttgttt

SEQ ID NO: 34376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggccgagtgtatgttgcacaagcttctt

SEQ ID NO: 34377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggctaccaaattgctcttgctgaccgat

SEQ ID NO: 34378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggctggaaccgccttgtgcccgggccgg

SEQ ID NO: 34379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggcttcggaaccactgtcttatgcgtcc

SEQ ID NO: 34380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgggaggcctgatctcagtgtcgttagcg

SEQ ID NO: 34381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgggatattcctgaacgcgactcgatggg

SEQ ID NO: 34382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgggcgcggctctcccggggacacctagc

SEQ ID NO: 34383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggggtatgcaaccacgcatgtgatggca

SEQ ID NO: 34384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgggtggtgaagtcctgatgacggtaagg

SEQ ID NO: 34385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggtcaagccggggtgattttgcgccgtg

SEQ ID NO: 34386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggtcatgcataatttagggcgtttgtgg

SEQ ID NO: 34387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggtccaggtcgtctcgtacttgcattgg

SEQ ID NO: 34388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggtccatgcgggagacactgcgtctagg

SEQ ID NO: 34389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggtccgtgaactgtggctccgcaggcac

SEQ ID NO: 34390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggtcgtaggcgtatgcctttttagttcg

SEQ ID NO: 34391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggtcttgtgcttctcctcgttatttgtg

SEQ ID NO: 34392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggtgccggtgtgcttccatgcttccctg

SEQ ID NO: 34393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggtgcctgtctcaccatgttcgtttctc

SEQ ID NO: 34394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggtgtctgattgtaggagttcacccgtt

SEQ ID NO: 34395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcggttactctcttgttatctgcctcgggt

SEQ ID NO: 34396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgtcatgtgcttgccgatactcagtgtgt

SEQ ID NO: 34397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgtccaccgttgttttagacctggcgtaa

SEQ ID NO: 34398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgtccatttcgaccacgtccacggttcct

SEQ ID NO: 34399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgtccgccaagtggattccaatgccggaa

SEQ ID NO: 34400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgtcgggcatcgagtattacttaaccctc

SEQ ID NO: 34401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgtcgggggggtgtcaacggcgtttccgc

SEQ ID NO: 34402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgtctggatcgcgccaagttgtggctgtg

SEQ ID NO: 34403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgtgaaagaatacgcttgcgatctacgct

SEQ ID NO: 34404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgtgcacgaattgtccctgctttaatatt

SEQ ID NO: 34405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgtgccacgttccctggtacagcgtcctg

SEQ ID NO: 34406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgtgcccggcccactccgattggatgtgg

SEQ ID NO: 34407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgtgcttaagtttatggggtttaaggcat

SEQ ID NO: 34408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgtgtaattcgacagtgtaaatatttcct

SEQ ID NO: 34409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgtgtcaatctctttaagggtgcgttctc

SEQ ID NO: 34410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgtgttcttctcaggtaaaataagattct

SEQ ID NO: 34411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgttaaagggagggtaatttaaccttgcg

SEQ ID NO: 34412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgttatcattgatttcatgggtacttcgg

SEQ ID NO: 34413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgttcggcttggcttacaagatcagtcgt

SEQ ID NO: 34414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgttcggggcgttgcaatcgggttaagtc

SEQ ID NO: 34415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgttcttctaccgaggttagcgcgggacg

SEQ ID NO: 34416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcgttgactttggcctacgtgctgtgccgc

SEQ ID NO: 34417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctaacgaggcagggtacgcgacagcgacg

SEQ ID NO: 34418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctaagcccttgcccctacgccaccgtcgt

SEQ ID NO: 34419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctaattctgattaggccctcttgcttctt

SEQ ID NO: 34420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctacatgtatggcggattcaactttacgt

SEQ ID NO: 34421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctacgatggatgatgggggattaaagcgc

SEQ ID NO: 34422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctacgtggattacactcgggaggccggcg

SEQ ID NO: 34423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctacttgcgtgcggttggatcttactata

SEQ ID NO: 34424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctagcttgcggttggagcgtttggagaat

SEQ ID NO: 34425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctagtaatgtgcttagcataccattgaca

SEQ ID NO: 34426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctagtctatattctatatttaacaacctc

SEQ ID NO: 34427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctagtgcgttcagcttgccacagcgattg

SEQ ID NO: 34428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctatgctactacacgcatcgcgtcaccgg

SEQ ID NO: 34429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctattatcgtgtgaatgtagctcattgtt

SEQ ID NO: 34430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctcaaataaggctcgttggcattctgggc

SEQ ID NO: 34431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctcaatcgacttgtcaaactgtcgtcggc

SEQ ID NO: 34432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctccataggggtatggaagttatcctcgt

SEQ ID NO: 34433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctccattgccgaaccgtaggcatcgtaac

SEQ ID NO: 34434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctcccttttacgatggtttcttcggtcta

SEQ ID NO: 34435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctcctaagtaattcccccctggaattgct

SEQ ID NO: 34436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctcgacccagcgatgatgcgaggcggtcg

SEQ ID NO: 34437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctcgagaacgaagcttgggtccctgtggg

SEQ ID NO: 34438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctcgatgaggtttagccaccgaatccagt

SEQ ID NO: 34439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctcggggaccaagattgttcggtcttttc

SEQ ID NO: 34440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctcgtaaatatgcatagtcctaggtatgc

SEQ ID NO: 34441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctcgtactttgcgtgaccttcccggctta

SEQ ID NO: 34442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctcgtgtctaaggcgtggcgtaaactgca

SEQ ID NO: 34443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctcgttactgtagcgcgaccgcaatgagc

SEQ ID NO: 34444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctctatgtcttcacgggacatgctcattc

SEQ ID NO: 34445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctctggtgattagaccggcacgatgcgat

SEQ ID NO: 34446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctctgtatgcaccagaaaggtttcgtgcc

SEQ ID NO: 34447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctctgtgttcctccgtacagacattgatt

SEQ ID NO: 34448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctcttatgatggcacagttattctgcctg

SEQ ID NO: 34449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctgactggcagaatggctgggcgcacaac

SEQ ID NO: 34450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctgacttgacagtaacaaatgactgaccg

SEQ ID NO: 34451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctgcgtgggcatccgttgagaggcttatt

SEQ ID NO: 34452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctgcgttggactagggtgtaaggtggcgg

SEQ ID NO: 34453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctgctacttaatggtcaaacccgctcgag

SEQ ID NO: 34454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctgctcttttcgggacagttgcaaccttc

SEQ ID NO: 34455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctggaacagaccgcttcttcttcactatc

SEQ ID NO: 34456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctggaagggaggtgggttgggtcgcgtat

SEQ ID NO: 34457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctggagaacccgtacggatttttgtgcga

SEQ ID NO: 34458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctggataagacggtcctttttttgttggc

SEQ ID NO: 34459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctggggctatctatcaaggtggggggtgg

SEQ ID NO: 34460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctgggggacgttttatttctttggtactt

SEQ ID NO: 34461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctgtatagcaagtatgtgacaagtcggtt

SEQ ID NO: 34462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctgtggtgtgatttgtcgccccgttccgg

SEQ ID NO: 34463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctgtggtgtgggtcctttcgagttgctgg

SEQ ID NO: 34464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctgttggagaagttgaggctcgaaatggc

SEQ ID NO: 34465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctgtttcgaatgcacaaatctggcgatcg

SEQ ID NO: 34466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcttaaactttcggcctcttttctgctttc

SEQ ID NO: 34467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcttatcacggcgagtattgagcacgggtg

SEQ ID NO: 34468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcttccattcgtaacttgcatctgcagggt

SEQ ID NO: 34469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcttccccccacctgtactcatgtgacgta

SEQ ID NO: 34470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcttccctttataaattactcttaccattt

SEQ ID NO: 34471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcttcgaccttcctgatccggcttgcacgt

SEQ ID NO: 34472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcttctaagtgaacacttcgtgtttgcctt

SEQ ID NO: 34473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcttcttgtgaggtgcacttgccccgacat

SEQ ID NO: 34474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcttgattgtggcgaattgctgccggagtc

SEQ ID NO: 34475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcttgcattccacgtggctggcactttaag

SEQ ID NO: 34476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcttgcgttgcggtacaggaatggatggtt

SEQ ID NO: 34477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcttggcacgctaagagtgttcgttgtcac

SEQ ID NO: 34478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcttgtaaaacatcctttttagtgtttatc

SEQ ID NO: 34479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcttgtatctcgtcgcatttataagggtag

SEQ ID NO: 34480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgcttgtggtacgctcgataggtgccttatt

SEQ ID NO: 34481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctttaacatttgggttgtagctagccccc

SEQ ID NO: 34482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctttatcttttataggtccgaggtaggtg

SEQ ID NO: 34483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctttccgatcgataggggaggtgaatggg

SEQ ID NO: 34484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctttcgtgcgtcaatgatatcgtatgtca

SEQ ID NO: 34485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctttgaggccgaaaggcgagaacttttgg

SEQ ID NO: 34486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctttgagttctgtatgctttgcgacgacc

SEQ ID NO: 34487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctttggtatgtcattatctatgatcttgg

SEQ ID NO: 34488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctttgtaggtcctcgctcgatggtgcgaa

SEQ ID NO: 34489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgctttttctttccgtactccacgggcgcac

SEQ ID NO: 34490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaaacgtttcgtcacgaccaccgtgaggc

SEQ ID NO: 34491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaacgcgccgtgagctgccagagaccagg

SEQ ID NO: 34492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaactgcgtatgtttggccgtgggctgat

SEQ ID NO: 34493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaactgggggatcgctcggattctcatag

SEQ ID NO: 34494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaactgtcatagattgacactgctggtgc

SEQ ID NO: 34495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaagaggacttcaaggcaagtgcattagc

SEQ ID NO: 34496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaagagttaatatgctttctcccttaaat

SEQ ID NO: 34497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaagctgaccttcatccccgcaacggacg

SEQ ID NO: 34498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaaggaacgggcccttcgctcagcgaaat

SEQ ID NO: 34499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaaggaggtgttcgacccggtctgtatcc

SEQ ID NO: 34500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaaggagtaattgacgtgttacgtagggc

SEQ ID NO: 34501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaaggccggcccccgatgccccaatgcac

SEQ ID NO: 34502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaaggcttatggcttgaccgatgattgga

SEQ ID NO: 34503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaaggtgtagaactgtgtcactgagaagc

SEQ ID NO: 34504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaagtgcaggaaacgcctcccgcgatcgc

SEQ ID NO: 34505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaatatgattgccttttgagtattctgct

SEQ ID NO: 34506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaatcgtaatacttgattatgggcatcat

SEQ ID NO: 34507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaatgcgtctatccgctgttagcggcctt

SEQ ID NO: 34508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaatggtatattattgcctggcttcattt

SEQ ID NO: 34509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaatggtatccacccgccgtacacgcctg

SEQ ID NO: 34510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggacaactccgaaaacaaagcggttgatct

SEQ ID NO: 34511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggacaattacttcgggtactagagcgtact

SEQ ID NO: 34512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggacacgcagattggcgccgatctgcaggg

SEQ ID NO: 34513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggacagatctctgctcgttcgccccgtgtt

SEQ ID NO: 34514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggacaggtgtaatgattaccaaccaagact

SEQ ID NO: 34515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggacatctcgcctttgaagggctggttggc

SEQ ID NO: 34516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaccacgaagtagcagattgtagtccgcg

SEQ ID NO: 34517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggacccaggagagcagtagtcggggcggcg

SEQ ID NO: 34518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggacccccagaggtctttggatggcaagcg

SEQ ID NO: 34519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaccgagagatgcaagggtattacttggc

SEQ ID NO: 34520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaccgcgcgttctgggttggccgtctttt

SEQ ID NO: 34521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaccgctttctacgtgttaaggattagtt

SEQ ID NO: 34522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaccggggcaggtacaatgggcaccgacg

SEQ ID NO: 34523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaccttccaacgttgaaagcgtaatcgtg

SEQ ID NO: 34524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaccttgagagatatggctgttttatggt

SEQ ID NO: 34525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaccttgagtaaagtgtgcctcgtccttg

SEQ ID NO: 34526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggacgctacacaaggacacaaggtattcga

SEQ ID NO: 34527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggacggcgcgggtccgaatgtgggggcagg

SEQ ID NO: 34528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggacggggtgcggaagggtcgagcaatcga

SEQ ID NO: 34529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggacggtcacaatacgataagcatggtcgg

SEQ ID NO: 34530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggacggtgggcacgtgattcttccggtgca

SEQ ID NO: 34531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggacgtgatgtattcggctgcactgcaacg

SEQ ID NO: 34532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggacgtgctccgactaccgccggtagctgc

SEQ ID NO: 34533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggacgtgtggccgttcttctgtccgggccg

SEQ ID NO: 34534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggactccgcggtggtatgacgagaccaagt

SEQ ID NO: 34535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggactctagtgtcaactcacaggagtgcac

SEQ ID NO: 34536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggactgtgatgacgctcggcaaaggtcagc

SEQ ID NO: 34537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggactgttactttccaaacatctggtggtc

SEQ ID NO: 34538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggacttgaggcaattggagaatgtatgggg

SEQ ID NO: 34539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggactttcggcttcgttggactcatacagc

SEQ ID NO: 34540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggagagatggcgtcatgcgtatcacactcg

SEQ ID NO: 34541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggagcaggcacatgcagctgggcttccccg

SEQ ID NO: 34542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggagccgctgtcgagctgtacaacggagag

SEQ ID NO: 34543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggagctgatgcgtgttatcgtctctgttgc

SEQ ID NO: 34544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaggacacaagaggggacccaaattatta

SEQ ID NO: 34545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaggacacggacctgaaatgcgatatgtc

SEQ ID NO: 34546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaggaccaagacgcaggtaaacgcgtttc

SEQ ID NO: 34547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaggaccggatctgaaacctgatgggtaa

SEQ ID NO: 34548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaggagccgcggaggtgagcaggacactc

SEQ ID NO: 34549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggagggacgctcgattattggaggtcgggg

SEQ ID NO: 34550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggagggccgtaagacttgtcgaattgcggc

SEQ ID NO: 34551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggagggccgttcaatcggtgtgggtcgtgg

SEQ ID NO: 34552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggagggttcagagttacgttaggagggacg

SEQ ID NO: 34553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaggtacagatgtaggatctttgtagcga

SEQ ID NO: 34554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaggtcccgtagaaggtctcgagatacgg

SEQ ID NO: 34555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggaggtcggtaccttgcattcgcgaacaag

SEQ ID NO: 34556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggagtatgcttttagacatgtctttcagcg

SEQ ID NO: 34557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggagtggacggccggtccccagcgcggttg

SEQ ID NO: 34558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggagtggcagaccgggttattgggtgtaat

SEQ ID NO: 34559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggagttacagtttcgggggttggtaggcga

SEQ ID NO: 34560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggagttctcggaatgtattcgacaggtcgc

SEQ ID NO: 34561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggagtttctactcacttatggtaggctact

SEQ ID NO: 34562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggagtttgataaattcttctccgctgctgc

SEQ ID NO: 34563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggataccgctcgctgaggttcagtacgggg

SEQ ID NO: 34564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggatacgctacaccttcaagtggctccttt

SEQ ID NO: 34565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggatccgctgagcaacagatgacgtggcgc

SEQ ID NO: 34566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggatcgagcgcatcatttcccgagtgtaac

SEQ ID NO: 34567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggatcgatttagatgatacatgaccgattg

SEQ ID NO: 34568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggatcggagggctatgcgcaccgcccggaa

SEQ ID NO: 34569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggatctgggaactgtctttcatgctccatg

SEQ ID NO: 34570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggatgcaaggcctcatcacaccattcgact

SEQ ID NO: 34571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggatgcactgccagggactgccacagtttt

SEQ ID NO: 34572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggatgccgcggtagttccctctccttcgtt

SEQ ID NO: 34573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggatgctactgtgatagaggtgtccctatc

SEQ ID NO: 34574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggatgctagcatatcggggggttagggtcg

SEQ ID NO: 34575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggatggaccagtgagtacacgcgagtgcga

SEQ ID NO: 34576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggatggcagtgaactggaacacccatcgtg

SEQ ID NO: 34577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggattcttgcgtctgttttggatacacgtc

SEQ ID NO: 34578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggattggatgtaacgacggtggctgattcc

SEQ ID NO: 34579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggattggcagccccaaggtaaagatgccgg

SEQ ID NO: 34580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggatttcggcctcatcaacttgttctccga

SEQ ID NO: 34581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcaaaatggatgcggtcctcttctagtcg

SEQ ID NO: 34582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcaaagtaccgtattggcgtggatggatc

SEQ ID NO: 34583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcaacagtagaactgttgatagggcctac

SEQ ID NO: 34584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcaacgtgtgcgcggtttgacaacccgga

SEQ ID NO: 34585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcaatcgaccgtctactttgtgggtgaac

SEQ ID NO: 34586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcaatggggcggttacagacatcttttgc

SEQ ID NO: 34587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcaatgtccatatacgctaggggtgcgcg

SEQ ID NO: 34588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcaattgtttcctgccctcacggctgtgc

SEQ ID NO: 34589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcacaatgaccggtatgatctatcaccta

SEQ ID NO: 34590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcacacttacggttggcctcttggtggat

SEQ ID NO: 34591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcacagaaggggtgcgtaacggtgaatct

SEQ ID NO: 34592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcacccctgactgcgtttagttggcttgt

SEQ ID NO: 34593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcacctacgtcggtagttcgtgtagttca

SEQ ID NO: 34594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcagacgatgccgttgagacgtgctctta

SEQ ID NO: 34595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcagattatccggcacgcgggttctcaca

SEQ ID NO: 34596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcagctgcataccgctcgttatcaatttt

SEQ ID NO: 34597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcaggaacaaccgtaacgacctaatcgta

SEQ ID NO: 34598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcaggactggttgcgagggttctaatcac

SEQ ID NO: 34599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcaggtgaagacgttgtaagtgcggggta

SEQ ID NO: 34600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcaggtgggtgaagtcggtcagagcagtt

SEQ ID NO: 34601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcagtgaggttgtacggggactttacgag

SEQ ID NO: 34602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcatatctgaggtatcaatcgttgtcggc

SEQ ID NO: 34603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcatcacatgattgttcttgccgtccggg

SEQ ID NO: 34604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcatctggaacgtctttaattgggtgatt

SEQ ID NO: 34605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcatgctgtagtagtcactaccggtcccg

SEQ ID NO: 34606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcattataccactcacttccagatacctg

SEQ ID NO: 34607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccaaatcgcgttatggtgcccgtgtggg

SEQ ID NO: 34608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccaacggttcgtacattctagttcttgt

SEQ ID NO: 34609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccaaggggctgttctcagatggatcggt

SEQ ID NO: 34610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccaagggttccgggttttcaagcggtca

SEQ ID NO: 34611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccaatgacggttattcgggcctccccgt

SEQ ID NO: 34612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccacgaagggtaactggggtgcatccgg

SEQ ID NO: 34613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccacgtccgtggttttttcggatcaatt

SEQ ID NO: 34614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccacttgctgtaacgggcctttccttat

SEQ ID NO: 34615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccagagctcaaacagccatttgcatccc

SEQ ID NO: 34616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccaggctcgatcacccaacatctttaac

SEQ ID NO: 34617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccatgttcgcctggggtacgggtaacta

SEQ ID NO: 34618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccattgcttattaaatacaggcggcctt

SEQ ID NO: 34619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcccatcgacatgacgtcttgccggcgtg

SEQ ID NO: 34620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcccgctatcgattgtttagctgaggaca

SEQ ID NO: 34621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcccggctctagtgtgatttagccagggg

SEQ ID NO: 34622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccctcctacagattctagtcgcatggct

SEQ ID NO: 34623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccctcgctttttagtctgtataacgcct

SEQ ID NO: 34624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcccttgtgttgctgttcacgccatggta

SEQ ID NO: 34625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccgaagggttgatttacggtgatctacg

SEQ ID NO: 34626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccgagctccggggattagtcggctgttg

SEQ ID NO: 34627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccgaggcggtcgttttagcttgggctaa

SEQ ID NO: 34628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccgcaaacgcaacctagttttgccgttc

SEQ ID NO: 34629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccgcctccctagctgtatcagacgttac

SEQ ID NO: 34630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccgcgttcacgcaaaagtgagcttcaca

SEQ ID NO: 34631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccggacgtgttaatccgacttcggggga

SEQ ID NO: 34632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccgggacgctgacattctgaattgagac

SEQ ID NO: 34633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccggggtaaacgtgtaggggggatgggt

SEQ ID NO: 34634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccgggtgttcggtcagtgcggttccgtt

SEQ ID NO: 34635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccggtgcttttcagaccttcatgggtcc

SEQ ID NO: 34636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcctcatttgggacatatttctcattagg

SEQ ID NO: 34637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcctggggcggagtgatcagcattcgtag

SEQ ID NO: 34638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccttaagcaattgcgagtagcactctcg

SEQ ID NO: 34639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggccttgattctggaggcacgctgacggca

SEQ ID NO: 34640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgaactcgtgcactcagcactttgcgct

SEQ ID NO: 34641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgaagctgtacgggtctcgtcaacacca

SEQ ID NO: 34642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgagtggagtctgatgatacaaccaacg

SEQ ID NO: 34643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgataaactgggccactgcgcacgccgt

SEQ ID NO: 34644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgatgagaatagcttacctccgttgcaa

SEQ ID NO: 34645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgatggcttccgttacagtgatcacgac

SEQ ID NO: 34646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgatgtctgtttttatatcggagccccg

SEQ ID NO: 34647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgcatctgcatggagggctcctaggttc

SEQ ID NO: 34648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgcgtggactcacacaccttaggacgtg

SEQ ID NO: 34649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcggaagtggggttagctaagctgatcaa

SEQ ID NO: 34650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcggacgtgtaatgttgcataaccttggc

SEQ ID NO: 34651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcggataggtttgatcggtgaccaagccg

SEQ ID NO: 34652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcggcactagttatctcccaccttgacgg

SEQ ID NO: 34653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcggctagtcgacgtccgttgaatttgat

SEQ ID NO: 34654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgggattgtcgctatccgactttggaat

SEQ ID NO: 34655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgggccttgaatggcacctctttggagg

SEQ ID NO: 34656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcggtagttcgggaacgatagactcaatg

SEQ ID NO: 34657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgtacaactgggcatcggacgcgatgtt

SEQ ID NO: 34658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgtacccagaatgtccttggccggaccc

SEQ ID NO: 34659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgtagaaaccggtgccgagcttgttcgt

SEQ ID NO: 34660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgtcaaagggagtaatcgccgataggtc

SEQ ID NO: 34661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgtcaatcggagaagcacatcgcacagt

SEQ ID NO: 34662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgtcgaggtacaacacatcgggtatagg

SEQ ID NO: 34663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgtgcggtcgacgtcgacgaatcaatga

SEQ ID NO: 34664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgtggtatccaaggatgcagaagcaagc

SEQ ID NO: 34665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgttaaactaggcattgcgagccaaggc

SEQ ID NO: 34666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgttacgtcctcaatcttaaacttgtga

SEQ ID NO: 34667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcgttcgactacactttgtcttgcgttta

SEQ ID NO: 34668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggctaactggaccaatatcgtcaagcttct

SEQ ID NO: 34669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggctacacagcgtgcattgatgaaatcgtg

SEQ ID NO: 34670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggctacctcggtgtttgttcccttgatcgg

SEQ ID NO: 34671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggctagacatccgatgtgtgctgggggcaa

SEQ ID NO: 34672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggctaggcttcactcattcctttatggtcg

SEQ ID NO: 34673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggctatcacattgctgtgaacaatgtaagg

SEQ ID NO: 34674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggctcctgatctgtacagtttcggttaccg

SEQ ID NO: 34675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggctcgatggtaaggtggcttttggagatg

SEQ ID NO: 34676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggctcggggaaaagtatttagtcaaatagg

SEQ ID NO: 34677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggctctttggtgcatttggctcgcttccaa

SEQ ID NO: 34678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggctggagcctggcgtgtccctgagtgcgt

SEQ ID NO: 34679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggctggcacacgtttggtaatccctgcacc

SEQ ID NO: 34680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggctggtcgggcgcggaatctttcggtttt

SEQ ID NO: 34681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggctgttccttgtttctcatgctaggtagt

SEQ ID NO: 34682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggctgttggcacgggtgctccaatgtggta

SEQ ID NO: 34683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcttaactcaagatctgataaattacata

SEQ ID NO: 34684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcttacgcttggtaacgttagcgaccccg

SEQ ID NO: 34685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcttagttgtccggggcatattacgtctc

SEQ ID NO: 34686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcttcacgttggccccacgcggtattgtt

SEQ ID NO: 34687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcttcatatcgggtttggtgctcggtagc

SEQ ID NO: 34688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggcttggtatgcgagttgcgtcaccgctac

SEQ ID NO: 34689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggctttatatcgccttacttttatcctcgg

SEQ ID NO: 34690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggctttgtatacttctacagatggacattc

SEQ ID NO: 34691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggaaattcactgctttcgttacaacccct

SEQ ID NO: 34692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggaaccgcaacggctaatagctccaggct

SEQ ID NO: 34693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggaacgctagtgtgttcgcacgcaatgct

SEQ ID NO: 34694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggaacggtggatcggaggggtgtagcgtt

SEQ ID NO: 34695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggaataaacaaggtgtaggtggtgcagtg

SEQ ID NO: 34696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggaatgtgtttcataggagctctccacgc

SEQ ID NO: 34697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggaattgttaaataatatttcctatggta

SEQ ID NO: 34698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggacggcagcgcataaacgcggctgcgtt

SEQ ID NO: 34699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggacggcggccatattgtatcggtgctta

SEQ ID NO: 34700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggacgtaattgacagcagttcacgtttcg

SEQ ID NO: 34701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggacgttggcccgtactaataggttaatg

SEQ ID NO: 34702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggacgttgtggcttgtacgtgtaggaact

SEQ ID NO: 34703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggagacaagggtgttctagtttgttactg

SEQ ID NO: 34704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggagagcgtgcgttcaattgttatgaacc

SEQ ID NO: 34705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggaggaactgatcaagagcactgcgagac

SEQ ID NO: 34706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggaggctgccatggttagggatggtgccg

SEQ ID NO: 34707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggaggtccccactagaaagttggtaggta

SEQ ID NO: 34708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggaggttagctgtcggctcatatggggtg

SEQ ID NO: 34709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggagtgatgtgttaagtatgttcagttgc

SEQ ID NO: 34710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggagtgggttacacagtccaacacataca

SEQ ID NO: 34711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggatagcgacagttgagggggacagtggt

SEQ ID NO: 34712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggatcttgattcagttgaacgattggggg

SEQ ID NO: 34713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggatgacagtcgttcggtggtcgaccgca

SEQ ID NO: 34714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcacacaaccactcagacaagagggaga

SEQ ID NO: 34715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcacctattcaggacccgaccccacgaa

SEQ ID NO: 34716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcacctcaacagtctggtgtggcacttc

SEQ ID NO: 34717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcacgagcacgtggagtcagcgatggcg

SEQ ID NO: 34718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcacgtgcatagatctgcctaatctagg

SEQ ID NO: 34719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcagaacaatgtgcagtatgctagagcg

SEQ ID NO: 34720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcagctgcaggggcctgcgcgggagtgt

SEQ ID NO: 34721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcatgagcgttaacacgattgtcatgca

SEQ ID NO: 34722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcattcggctgctttctggccggcttct

SEQ ID NO: 34723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcattgcatgctatggggttccgttttg

SEQ ID NO: 34724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggccactatcgctctttggccctagtcgg

SEQ ID NO: 34725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcccaagacaactgcttctctcgtagcc

SEQ ID NO: 34726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggccctcgagttggtgaccttgctcgtac

SEQ ID NO: 34727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggccggcaatagtggattcgattcctggt

SEQ ID NO: 34728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggccggtggcaagataaattagcacgagc

SEQ ID NO: 34729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcctactgctgtaaatgctctcaggtgc

SEQ ID NO: 34730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcgatcataggttcatgttcttagacgg

SEQ ID NO: 34731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcggcgtttactttggacgtccgatgcg

SEQ ID NO: 34732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcgggggtccgttctgttcgctaacagt

SEQ ID NO: 34733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcggtacgagcaatgagaggtctctccg

SEQ ID NO: 34734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcgtacataggcgactggaggcgtgaat

SEQ ID NO: 34735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcgtcatgctaagtcccaacctttctat

SEQ ID NO: 34736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcgtctttggtacgtcaattgcctgaac

SEQ ID NO: 34737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcgtggtccatggaggccgctgatatct

SEQ ID NO: 34738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggctactagatgcgtcgtgggtttttcgc

SEQ ID NO: 34739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggctccgttttgccttcaccgccgggttg

SEQ ID NO: 34740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggctcgggcgctgcggttggtatggcttg

SEQ ID NO: 34741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggcttccagcagctagttctagcatcgca

SEQ ID NO: 34742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggaaattacgttatcgtccccccgcgag

SEQ ID NO: 34743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggaacatgtacattttgctgcgcccgcc

SEQ ID NO: 34744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggaccggcggatcaagcttcactcgagg

SEQ ID NO: 34745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggacgggccctgattggcaacaactgct

SEQ ID NO: 34746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggaggacgattttttggcggcttccgga

SEQ ID NO: 34747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggatatgtacgccacacagatagtcttc

SEQ ID NO: 34748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggccacattcgacgacctcgttccgcac

SEQ ID NO: 34749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggccaggcgttcggatatgacgcgtcac

SEQ ID NO: 34750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggccgggaaggttaacgatatctctcac

SEQ ID NO: 34751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggcgcgctcagctggttcgggtttgagg

SEQ ID NO: 34752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggctagacctcgtactcgtgtcgaatta

SEQ ID NO: 34753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggctccaatcatgttccatccgatatgg

SEQ ID NO: 34754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggggaacgcgctgtgagagtgcgagtgac

SEQ ID NO: 34755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggggagtgccgagcgtggctggcaaggcg

SEQ ID NO: 34756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggggcagtcttttctcggattaatgctcc

SEQ ID NO: 34757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggggacgtctccgagttcaccaagagca

SEQ ID NO: 34758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggggagatcatacgcgggcttctatgcg

SEQ ID NO: 34759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggggtcgttagtaagcgggtgtcacttgt

SEQ ID NO: 34760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggggtctggggtcactctcttatggactg

SEQ ID NO: 34761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggtagatctagtggagtgcgcgcgagca

SEQ ID NO: 34762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggtcaaatgtccctggaccgtgaagccg

SEQ ID NO: 34763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggttcgggaagttaggtgtttggcttgg

SEQ ID NO: 34764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggttgagggcattccctctgatgagatt

SEQ ID NO: 34765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggggttgtgtccactgggaagctgctttgg

SEQ ID NO: 34766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtaaggcttcaaccgggccgcggtattc

SEQ ID NO: 34767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtaagtggcgcccgactcgcggcttgtg

SEQ ID NO: 34768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtaatggctcagtacgcggcggtacctt

SEQ ID NO: 34769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtagcagcgagacgttctattacgggcg

SEQ ID NO: 34770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtaggtgaacgggagggtgatgcaaggc

SEQ ID NO: 34771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtaggtgaaggtagtgtggcgatcttgg

SEQ ID NO: 34772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtattagccgaccttgattgcgtcgatt

SEQ ID NO: 34773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtattgtttctgcagggtttcgtaaggt

SEQ ID NO: 34774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtcaagcggtcttagcactcaagtagta

SEQ ID NO: 34775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtcatggacgtcgacctccgagttagtt

SEQ ID NO: 34776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtccaaaaatggtctgcacgacgttctt

SEQ ID NO: 34777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtccaagccaaggttctgcacctgggga

SEQ ID NO: 34778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtccaatgatcccgaactggttggcacc

SEQ ID NO: 34779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtcctgttgggctggggtcggtcttgat

SEQ ID NO: 34780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtctcgaagcaatcaggttttgaggatc

SEQ ID NO: 34781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtctttttggcctatcgcgtgggtgtga

SEQ ID NO: 34782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtgaccggcttggatgatgtgcaggtcc

SEQ ID NO: 34783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtgagggtgatgtctagtactgcacact

SEQ ID NO: 34784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtgcctctggccggatggcacgtggttg

SEQ ID NO: 34785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtggaggactgcaaaacgataacgtgtc

SEQ ID NO: 34786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtggagtacgaacgaaagaccatatccc

SEQ ID NO: 34787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtgtcgtcagaatgtatcatgtgcttta

SEQ ID NO: 34788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtgttagagaaacgagacaggttacttt

SEQ ID NO: 34789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggttaagttcgtgtgccaaggtgacagtg

SEQ ID NO: 34790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggttacagagcaacctgatgctggtgccc

SEQ ID NO: 34791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggttacccacgtgtcgtattttaacggcc

SEQ ID NO: 34792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggttacttcgtttccggatctccgtctgg

SEQ ID NO: 34793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggttatgcgggctttgacgcgtaagcgac

SEQ ID NO: 34794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggttcatgttcccaagggtgaccggctag

SEQ ID NO: 34795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggttggtaaggagaaggggttgtcctccc

SEQ ID NO: 34796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgggtttgggaacttttctcttccgcgcctc

SEQ ID NO: 34797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtaatcatcatgcacgttactgttagcta

SEQ ID NO: 34798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtaatgtcacatcataactttcaatagtt

SEQ ID NO: 34799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtacaacggtgatcaacgacgtcgaatcg

SEQ ID NO: 34800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtacacagcacgattgcaatggtggtttt

SEQ ID NO: 34801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtacatcttaaccgtaattacgggcgtac

SEQ ID NO: 34802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtaccaggctaagttcatttccctcctcc

SEQ ID NO: 34803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtaccgaagcttaggggccttttcctgtg

SEQ ID NO: 34804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtacgaagtcatcgtaatcgttattcggt

SEQ ID NO: 34805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtactactgtcgaaggggatcgtgcatcc

SEQ ID NO: 34806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtactgagggagtcgcttcagatttggtt

SEQ ID NO: 34807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtagcgctcctctctttggttcagactta

SEQ ID NO: 34808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtaggcgctcccttctaaacgggcggtac

SEQ ID NO: 34809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtaggcgtagtgaacatgcggggtaggag

SEQ ID NO: 34810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtaggcgttcttgattcaagaggatgtag

SEQ ID NO: 34811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtaggctactactatttagtcggtctttg

SEQ ID NO: 34812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtagggcaggccaaatgttattctcgcgt

SEQ ID NO: 34813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtatacgaacagaggcgcactggaagtca

SEQ ID NO: 34814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtatacgaccattgatagcgatggtgttg

SEQ ID NO: 34815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtatcaccaagaccctgaggcgagcgcga

SEQ ID NO: 34816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtatctgcattgcgaacacattaagcgtc

SEQ ID NO: 34817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtatgtgtactcgtcgtttgccggcacta

SEQ ID NO: 34818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcacaattcaactggattggcattcggt

SEQ ID NO: 34819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcacacgggcacgtcgtgctggatcttg

SEQ ID NO: 34820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcaccgtatcgaggctggtgtggaggct

SEQ ID NO: 34821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcacgtgcgctttttcctagtttcccgg

SEQ ID NO: 34822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcactcgctctggtggtcaacgtcatcg

SEQ ID NO: 34823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcacttaggcttatgaatcggcgttgta

SEQ ID NO: 34824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcagaagtacagattcgagtgtggagtc

SEQ ID NO: 34825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcagatcgcctcgttcaactaagtgaac

SEQ ID NO: 34826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcaggttcggcgataacccgagaacaag

SEQ ID NO: 34827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcatagatcactattccgttagtagaag

SEQ ID NO: 34828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcatcgtgggtagtcctgcgttaggtcg

SEQ ID NO: 34829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcatcgtgtgcgtaagggcaagtggcgt

SEQ ID NO: 34830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtccaggaagtcgaaaaggtcggtccgtt

SEQ ID NO: 34831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtccctaagatttcattgttacgactctt

SEQ ID NO: 34832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtccgcggatcggtgtttttgaactcggt

SEQ ID NO: 34833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtccgtccgttcgcgcaggccactgggaa

SEQ ID NO: 34834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcgaccagaaggaaggagacggggcatg

SEQ ID NO: 34835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcgcaacatcaggcgaacggactcggcg

SEQ ID NO: 34836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcgcatcttcgatattgctgttgggcaa

SEQ ID NO: 34837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcgcatgtcagttactcgacgaaccgac

SEQ ID NO: 34838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcgcggcttgtactatcatctcaacagg

SEQ ID NO: 34839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcggcgaggaaaatttatgctgctagcg

SEQ ID NO: 34840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcggttccctagcgtttttaagccggat

SEQ ID NO: 34841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcgtcactagggatcgtgtcgcagttcg

SEQ ID NO: 34842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtcgtgcggggtagtatgcggaaatggtc

SEQ ID NO: 34843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtctaggcgagctcgccacacggagtatg

SEQ ID NO: 34844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtctcgcgcctccgtgaatgatgctcgcg

SEQ ID NO: 34845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtctgaaacttccttcagctgacaccttc

SEQ ID NO: 34846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtctttgtattttgcatgcccctcactgg

SEQ ID NO: 34847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtgactgcgatggttatcggtaggtggat

SEQ ID NO: 34848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtgagatcgtagtttactccattctcctc

SEQ ID NO: 34849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtgagtcaaggaaccgtagtggcgctccg

SEQ ID NO: 34850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtgcatcagcgacccatgagccttgggag

SEQ ID NO: 34851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtgctaactcccaatataatcactgaatc

SEQ ID NO: 34852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtgctcggtgctgaagcgctttggcccgc

SEQ ID NO: 34853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtgcttaacttcgctgcgaatagtccgcc

SEQ ID NO: 34854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtggatcgtggcaacttgccgacattggg

SEQ ID NO: 34855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtggcaggtgttgtatttaccgtcccgtt

SEQ ID NO: 34856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtggcggggctttacgtgtgctctatgaa

SEQ ID NO: 34857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtggctgtattagcctcggcagcgtccat

SEQ ID NO: 34858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtgggaaatacccgcaaactgtgctagtg

SEQ ID NO: 34859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtggggtctgtcactccttgggggcctga

SEQ ID NO: 34860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtgggtgacgacaaaatgaggctcgctcc

SEQ ID NO: 34861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtgggttgctattccaagtgtgcgcccag

SEQ ID NO: 34862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtggtatcgctctcgttcgccggggcctc

SEQ ID NO: 34863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtggtcagcgttttatctttggcgggcgt

SEQ ID NO: 34864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtggttcgttcacggcaggaagagtttgc

SEQ ID NO: 34865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtgtactcactaggtttcggcgggcttgg

SEQ ID NO: 34866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtgtcccaatcgcactaagcttctggctg

SEQ ID NO: 34867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtgtgcatgctcctacgaattggtacttc

SEQ ID NO: 34868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtgtgcgctgaggaaaattcaagcctggc

SEQ ID NO: 34869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggttagctcggtggtaagagcgtttggctc

SEQ ID NO: 34870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggttatagctcgcgaccaaaccatacccac

SEQ ID NO: 34871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggttcaataggataagcgatggtcctccca

SEQ ID NO: 34872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggttcagttttcgggccatgtttgagacgc

SEQ ID NO: 34873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggttccagtcccgcttgatagtccgatatc

SEQ ID NO: 34874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggttcgggtctcgttcccggtagttgtcaa

SEQ ID NO: 34875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggttcggttgggacgtccctgcgacacgtt

SEQ ID NO: 34876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggttctacattcgcggtcgtaagaggcagt

SEQ ID NO: 34877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggttctaccattctgcgagctgctatatca

SEQ ID NO: 34878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggttctttcggtaatgatgtggattgcagg

SEQ ID NO: 34879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggttgaacacgagacaatcgcttagctgtc

SEQ ID NO: 34880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggttgacgcacatcaaggtacgtcttgacg

SEQ ID NO: 34881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggttgcagggttatgaccatcctcgacgga

SEQ ID NO: 34882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggttggcgtggaattggctggtccatccct

SEQ ID NO: 34883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggttggctattatttgagattgagaccttc

SEQ ID NO: 34884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggttggtgccggtcttcgatcgggctttgc

SEQ ID NO: 34885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtttaccatgccttactcgtaccctgttg

SEQ ID NO: 34886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtttattcggacaaggcttagactgatta

SEQ ID NO: 34887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtttcccgggtgaagttatgctaggaggc

SEQ ID NO: 34888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtttcggtgacggggtaaagttgtggacg

SEQ ID NO: 34889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtttcggttttgacccccggtacgccagc

SEQ ID NO: 34890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtttgaaaggtcagttgcaagccttgtcg

SEQ ID NO: 34891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtttggtagtagtgccttttcaggtacgg

SEQ ID NO: 34892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggtttgtattcgtattatttgctgtaattt

SEQ ID NO: 34893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctggttttccaacgcataccaaaggttgggga

SEQ ID NO: 34894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaaaaaccgggtgatatttcgccgagtcc

SEQ ID NO: 34895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaacacctcgaagacgaagtgaaacggaa

SEQ ID NO: 34896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaacagggggtgacatgatcaattgatct

SEQ ID NO: 34897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaaccacgagcggttgtaggagttacggc

SEQ ID NO: 34898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaaccgccctgtggtgcacccggtccgag

SEQ ID NO: 34899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaacgctcccccctgccatgccttcgcac

SEQ ID NO: 34900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaactatgattcgcgactgggctccggat

SEQ ID NO: 34901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaagacctatctgtaatcggagagactcc

SEQ ID NO: 34902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaagccggttacccgtccaagcagatcgg

SEQ ID NO: 34903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaaggattacctcgggaaagaaaatcgga

SEQ ID NO: 34904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaaggcacccgagacgatataggatcccg

SEQ ID NO: 34905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaatcccgtggtccatcataggctcgcga

SEQ ID NO: 34906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaatcggcaggagggtaatacacttcgta

SEQ ID NO: 34907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaattgaaatgccggactttctccgcggc

SEQ ID NO: 34908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaattgcgtcacgctcacctcgatgaggt

SEQ ID NO: 34909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtacagaccgtcaagacacccgggcggtag

SEQ ID NO: 34910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtacagcgtaggttatgttcttggtgcgtc

SEQ ID NO: 34911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtacaggtgcctatcacgtgttcgtcgtgc

SEQ ID NO: 34912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtacagtctcttgatctttgggagtgctat

SEQ ID NO: 34913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtacatgcgaagaatactgtcgggtcctgt

SEQ ID NO: 34914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtacatgctatcatattgaacatattgttc

SEQ ID NO: 34915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaccagagactaggtacaccgctcctgta

SEQ ID NO: 34916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaccagggggtccctgatcatggtatgtg

SEQ ID NO: 34917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtacccggcagaagatttgtgtcgcccgga

SEQ ID NO: 34918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaccgaattgtaaaatggtgctgtaggac

SEQ ID NO: 34919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaccggtccatctctaggcaactgctccg

SEQ ID NO: 34920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaccggtcggtcgatcttcattcgaacat

SEQ ID NO: 34921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaccttcgtctcgactcccctcagcctga

SEQ ID NO: 34922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtacgagtaattcaccttgatcaacctagt

SEQ ID NO: 34923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtacggacctcggtgccctctcccccggcg

SEQ ID NO: 34924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtacggcaacttgatgctggcagtcgcgat

SEQ ID NO: 34925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtacggcagtccccaagtccacgcttagcc

SEQ ID NO: 34926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtacggttttttatagagagttgacgggtc

SEQ ID NO: 34927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtacgtcacttgcctcctgttttatctgca

SEQ ID NO: 34928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtacgttagcgactctctggacgcaccggt

SEQ ID NO: 34929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtactaggccgagaacggagtaccttacac

SEQ ID NO: 34930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtactcggtcttcctaataacatttgacgt

SEQ ID NO: 34931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtactgctacttccacgcgcttctactgcg

SEQ ID NO: 34932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtacttcttaggttgagtctctctcccgac

SEQ ID NO: 34933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtagataatctagctggcgctggctatccg

SEQ ID NO: 34934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtagatcgttacatcttctgaggaccctca

SEQ ID NO: 34935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtagcaaacttacttaaatcggggacgcta

SEQ ID NO: 34936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtagcatgtaacctttagatcagtggggtg

SEQ ID NO: 34937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtagcgatcacaccgttcagtccacaggcc

SEQ ID NO: 34938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtagcggtacaccgacggtcagcagcgtta

SEQ ID NO: 34939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtagctaatcgttccgcagtctgcttagtc

SEQ ID NO: 34940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtagctgagtaccgtgggtctttgattctt

SEQ ID NO: 34941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtagctgggggcgtcgctagccatggctcg

SEQ ID NO: 34942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaggagccctaacacaagtggccttctgg

SEQ ID NO: 34943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaggagtagtgcccacactgcatagggat

SEQ ID NO: 34944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaggcatggcgtctttcctccgagtcatg

SEQ ID NO: 34945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaggcatttggtaatctgggttatagttt

SEQ ID NO: 34946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtagggacaggcatcgaggagttgtacctc

SEQ ID NO: 34947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtagggagtcgcacgggtactgtgcctcgt

SEQ ID NO: 34948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtagggattccgacgttggatggtcgccta

SEQ ID NO: 34949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtaggtttcggcccccatcagttttggtgc

SEQ ID NO: 34950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtagtgtatcatccctgtacttctgacaag

SEQ ID NO: 34951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtagttacctgttcctccaggcagctgggt

SEQ ID NO: 34952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtagttgtgacgaactcccacgagaagccg

SEQ ID NO: 34953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtataggatgtttatggaggtctcatgatc

SEQ ID NO: 34954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtatcgctgggagtgactacggtccgggac

SEQ ID NO: 34955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtatcgtggcaaatgaggtccgagatacgg

SEQ ID NO: 34956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtatgacggacaacctacgcgggcggctgg

SEQ ID NO: 34957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtatgccaagcaagcgttatatcaggatcg

SEQ ID NO: 34958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtatgctgtcaactcgttttcgtcggagtg

SEQ ID NO: 34959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtatggtgtcaattgttgtgctcattgtac

SEQ ID NO: 34960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtatgtgttttatactcgcgtccgtgcttg

SEQ ID NO: 34961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtatgttgcaatgcagcgattactgggggc

SEQ ID NO: 34962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcaaactttagctggcgggtagatctagc

SEQ ID NO: 34963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcaaggccgcatgacagtactctcgcgcg

SEQ ID NO: 34964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcaaggtagcctttggtttgggttgggta

SEQ ID NO: 34965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcacaagtacgtgcagcagtgctagtggc

SEQ ID NO: 34966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcacactttcgttaacgacctatgatctc

SEQ ID NO: 34967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcaccacggttggctacttctcgtcacgg

SEQ ID NO: 34968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcaccatgagatggcagcattcagtacat

SEQ ID NO: 34969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcacccggcgaccgtaaacaattcagtcg

SEQ ID NO: 34970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcacgacgagcgacaccattctcgccggg

SEQ ID NO: 34971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcacgtttgtgcggtttgggctcgcatag

SEQ ID NO: 34972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcactggctacaaaattacgcctccttaa

SEQ ID NO: 34973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcactgtgtctggaaggtgtctctttctc

SEQ ID NO: 34974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcagaccaaattgttaaacccgcgatggg

SEQ ID NO: 34975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcaggcgcgggtcttggcgggtcttcgcc

SEQ ID NO: 34976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcagggacgggggcatgtttggatcgcgc

SEQ ID NO: 34977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcagggtacggaacttgctcgagcttgat

SEQ ID NO: 34978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcatcgataccttctggtatctccgtgaa

SEQ ID NO: 34979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcatgtaagccgcgtggcacctgattggc

SEQ ID NO: 34980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtccacgacggtctgaaccaatgtctccta

SEQ ID NO: 34981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtccatcgcttcacagggaactagcggata

SEQ ID NO: 34982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtccattgctgtaacgttacttagctgcgt

SEQ ID NO: 34983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcccaaatgcgcgttatgaacgttgggat

SEQ ID NO: 34984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcccatctcagatcaagggttagtccggc

SEQ ID NO: 34985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcccatgctgagatgtctatgccttgacc

SEQ ID NO: 34986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcccgaggcggcacctcaggcgaacagcg

SEQ ID NO: 34987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcccgtcagcgttcgattcaggcagggtc

SEQ ID NO: 34988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtccgcgtctatcggtgtaccgaacccctc

SEQ ID NO: 34989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtccgctttcctaaataaccgctctgtcct

SEQ ID NO: 34990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtccggacaccaggttactagcgagtgaca

SEQ ID NO: 34991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtccggttttttaagcagtcgtcctgtact

SEQ ID NO: 34992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcctaggcctgacataccaacacgttggg

SEQ ID NO: 34993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcctcccgcatcgtacaggctcttacgat

SEQ ID NO: 34994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtccttgctttcacaacacttccctcgatc

SEQ ID NO: 34995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcgaaggcaggcgtgggatgtctcggtag

SEQ ID NO: 34996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcgagattgcattggacaacagtgtgaag

SEQ ID NO: 34997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcgagcgctcgtaagttttctcgatcaaa

SEQ ID NO: 34998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcgaggtctcatacgcagaattaccgcgc

SEQ ID NO: 34999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcgcaccacacatcccgattggcactgca

SEQ ID NO: 35000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcgccagattcaccgaggcattgagccct

SEQ ID NO: 35001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcggagtgtgtctctaggttaggtcgact

SEQ ID NO: 35002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcggcacgttcaggcttttcattctgttc

SEQ ID NO: 35003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcggcatggattaattgaaggcggggtct

SEQ ID NO: 35004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcgggaatagtcttgatgacaactccgcc

SEQ ID NO: 35005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcgggagtgaccgagcagctatatcctgg

SEQ ID NO: 35006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcgggctgcggctcctgttgtaaagaggc

SEQ ID NO: 35007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcgtaaaccccgtctactggcttttggtg

SEQ ID NO: 35008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcgtacgtcccaacaagccaagagatggc

SEQ ID NO: 35009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcgtatgcgataggacaataatcggaggc

SEQ ID NO: 35010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcgtatgtgcgccatgtccgcgtccacga

SEQ ID NO: 35011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcgtccacgtgtgcaatccgagtcgcaat

SEQ ID NO: 35012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcgtggacgaaagcgcgcgtcttgccacg

SEQ ID NO: 35013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtctaattttcggcatgcagggacatagac

SEQ ID NO: 35014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtctgcaagtcccatggcctgtttcgtttc

SEQ ID NO: 35015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtctggtctagagggccaattttcgcccgc

SEQ ID NO: 35016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtcttggtcgtattgcgcttcttgctaaaa

SEQ ID NO: 35017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgaaacgcaaagggagggcttcgtggtgg

SEQ ID NO: 35018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgaaagaccattcgctcacttaagtttag

SEQ ID NO: 35019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgaaatcggagctaagtatggccagtgcc

SEQ ID NO: 35020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgaaccgcggggtagtttctccgtctctt

SEQ ID NO: 35021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgaagccgttggatttagcgaggtttccc

SEQ ID NO: 35022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgaaggctaagcgcgcagagacccgttcc

SEQ ID NO: 35023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgaagttcagtgtacaacgtcttcaggat

SEQ ID NO: 35024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgaatagggtgtagactctctgcagctct

SEQ ID NO: 35025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgaatcacgacggatatgggtttttcttt

SEQ ID NO: 35026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgaattgggtgttgttttcagtactggcg

SEQ ID NO: 35027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgacagactattaatatttggcgaacgag

SEQ ID NO: 35028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgacaggatttttgtcgtttattggggcc

SEQ ID NO: 35029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgaccaggtgcttgcgaaagggcccgctg

SEQ ID NO: 35030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgacctagcggctggtcacgtgggttgtc

SEQ ID NO: 35031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgacgcgtacttaggcagatgggagatcg

SEQ ID NO: 35032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgacggacgtctgcggggagccgagacga

SEQ ID NO: 35033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgactcctatcgttctcgttcgctcatcc

SEQ ID NO: 35034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgagcgacctgagagggttattgcgacaa

SEQ ID NO: 35035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgagggtggatcaatgattttgtacgatg

SEQ ID NO: 35036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgagtccacaccgggcccgaccgctctgg

SEQ ID NO: 35037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgagtctattttgagggaggagtatgtgc

SEQ ID NO: 35038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgatcggcgtcccatcttacccggatgct

SEQ ID NO: 35039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgatgctacggctttacttttgtcgggcg

SEQ ID NO: 35040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgatggcagacgatgcgtttaggcgttca

SEQ ID NO: 35041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgattcatgcctggattaatatcctgatc

SEQ ID NO: 35042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgattggcgtctggagcttggcccattta

SEQ ID NO: 35043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgattttccctggcatcggttacagtcgc

SEQ ID NO: 35044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgattttggttgatgcaggaggcgaattt

SEQ ID NO: 35045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcaacgcgagaccaaataattaggttgt

SEQ ID NO: 35046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcactaactaagcatcttgaggtgtaag

SEQ ID NO: 35047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcagggtgtgcagaggccaacttggcaa

SEQ ID NO: 35048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcataaggaatgagcacctccattctag

SEQ ID NO: 35049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcatcggacgattcagtggaaaggcggg

SEQ ID NO: 35050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgccagcgggcccggcgagctgctgttct

SEQ ID NO: 35051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgccatttcccgtgcagtgtaaaggtctg

SEQ ID NO: 35052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcccatgacctacgcgtttagagatcgc

SEQ ID NO: 35053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgccgttagttttccaattgcgccattat

SEQ ID NO: 35054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcctggatcgccggaggaaaacgactta

SEQ ID NO: 35055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcgacgtgaccatctggccagggcgtgg

SEQ ID NO: 35056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcgatcggtcattcgtgatccttatcga

SEQ ID NO: 35057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcgcggagacgaggtgaatcgaacgggc

SEQ ID NO: 35058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcggagttatctggtggtcagcatcaag

SEQ ID NO: 35059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcggatacagtggttgacgccgagaaga

SEQ ID NO: 35060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcgggcgctgaacagcagctagcaacca

SEQ ID NO: 35061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcggtctcatattgcgtacattccatta

SEQ ID NO: 35062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcgtaactttgtcggcaaagttatcttg

SEQ ID NO: 35063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcgtacattaactaggtctctatgggga

SEQ ID NO: 35064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcgtcccgggcatttacgtgtatccctc

SEQ ID NO: 35065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcgttacctgctttcctgaagcgtcata

SEQ ID NO: 35066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgctattactgccccatccacaatttggt

SEQ ID NO: 35067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgctcgggaacgtctgaccttgttctgcc

SEQ ID NO: 35068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcttaaacggaaaggttgtgttgtgctc

SEQ ID NO: 35069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgcttcttgtctgagctaaggcgttgtac

SEQ ID NO: 35070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggaaatgcagataacggcactagcatgg

SEQ ID NO: 35071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggacgacagtccgagtacgagacgcggc

SEQ ID NO: 35072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggactcggttctattgcggtagaggtcc

SEQ ID NO: 35073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggagaccgattagcttgttgtctggtat

SEQ ID NO: 35074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggagagatggagagcttccgggttttgt

SEQ ID NO: 35075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggagcgtgcgaatttgctagccttgagg

SEQ ID NO: 35076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggaggtaaccgggctggagccgatctac

SEQ ID NO: 35077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggaggtgttatgatacgtccagtcctct

SEQ ID NO: 35078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggatcgggaacgacggacggtctaaggc

SEQ ID NO: 35079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggcacacgcgaggtcggcggataatgtg

SEQ ID NO: 35080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggcatgtgtaaatcaaacctatgaatca

SEQ ID NO: 35081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggcggagtgtgacccttcccgtttcgat

SEQ ID NO: 35082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggcgtgaaatcacgtcgcgggtttcata

SEQ ID NO: 35083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggctactaaccgttcagggtgggagagc

SEQ ID NO: 35084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgggagagagccggccaacgttctgtggc

SEQ ID NO: 35085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgggcaacggtaatactctacgtgtcgga

SEQ ID NO: 35086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgggcaggaactggcgctatgtatggctc

SEQ ID NO: 35087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgggcgagcaatacactctttgtggcggt

SEQ ID NO: 35088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggggtacggacagtaggccaggcggggg

SEQ ID NO: 35089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggggtcctgaggtcttggcccgcaggat

SEQ ID NO: 35090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgggtagtggaaatacgcatgcggggttt

SEQ ID NO: 35091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgggttgacctcggggtcgttaattcctg

SEQ ID NO: 35092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggtacgttgctacgggtcgatggtagcc

SEQ ID NO: 35093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggtcagactttacatccacaaaggaagg

SEQ ID NO: 35094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggtcctttgatctgcgtgttgggaggct

SEQ ID NO: 35095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggtgaatatgtattacgcttcctgtaga

SEQ ID NO: 35096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggtggtctcgtcacgtatcctaaacttg

SEQ ID NO: 35097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggtgtccggcacatttctaggggtcggc

SEQ ID NO: 35098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggtgtgacgacaaagggttcgtgtgcac

SEQ ID NO: 35099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtggttagctcatgcaatctttaggtgggt

SEQ ID NO: 35100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgtaatctgttcttttctgtgctgggaga

SEQ ID NO: 35101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgtacgatcaactgaccaaaccggctact

SEQ ID NO: 35102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgtacggtcaaaggtggatgccgaggacg

SEQ ID NO: 35103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgtatctagggtacgctcaagggttaggt

SEQ ID NO: 35104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgtcaaggttacttctataggcgggcctc

SEQ ID NO: 35105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgtcagcgcagcacacgtttcccggcttg

SEQ ID NO: 35106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgtcatatccgtccttaggcccgggttga

SEQ ID NO: 35107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgtccgttcgggttgtttcccagatctgg

SEQ ID NO: 35108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgtcgtgtagtgctcggggcctggtccgt

SEQ ID NO: 35109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgtgaaaataccgggaataggtcgttatg

SEQ ID NO: 35110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgtgcaatgcggacggatacccttggcgg

SEQ ID NO: 35111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgtgcagcatcgtactgctctcggacgcg

SEQ ID NO: 35112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgtgctggactgggaaggatatagaagct

SEQ ID NO: 35113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgtggattttaagcaagccacggtagcgc

SEQ ID NO: 35114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgtggctgcatgcgggttcgtagcagatc

SEQ ID NO: 35115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgtgtaccgctttagttccgcacacattc

SEQ ID NO: 35116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgtgtcaagttgagtccactatgcctctt

SEQ ID NO: 35117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgttaatgtcggcaaatcgcacgatattg

SEQ ID NO: 35118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgttaccatgtacgagtggacgcactccg

SEQ ID NO: 35119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgttcacgactggcaacttgtgagcggtc

SEQ ID NO: 35120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgttctctggttgttcccaacggcaaacc

SEQ ID NO: 35121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgttctgtgttcttggaacctgttacgtc

SEQ ID NO: 35122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgttgcacaatcggatacgtatgcccgaa

SEQ ID NO: 35123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgttgctagtgggactgttgatcgcggat

SEQ ID NO: 35124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgttgctcctgaaagccttcgatcgggga

SEQ ID NO: 35125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgttgtcgtctcgggttcactcatgtgat

SEQ ID NO: 35126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtgtttagataggaaaaatgcgattgtcat

SEQ ID NO: 35127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttaaaggccactgactagggaggatcgtg

SEQ ID NO: 35128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttaaagggttgtggcatcgatttaactga

SEQ ID NO: 35129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttaaatggtatcaactagccttgggattc

SEQ ID NO: 35130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttaacactttgttcgaattaatcaccgtt

SEQ ID NO: 35131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttaagccatttcggttatttccattccat

SEQ ID NO: 35132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttacagtccatgcacatttgtaggaatta

SEQ ID NO: 35133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttacctcagaaaactttcatttccggctc

SEQ ID NO: 35134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttacgcgggttcggttagctcgatcagtc

SEQ ID NO: 35135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttacgtgctcttggtctaatccatctgca

SEQ ID NO: 35136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttactcattttgatatttgcgcatacttc

SEQ ID NO: 35137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttagcacaaaccgtgttcatcgtggttag

SEQ ID NO: 35138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttaggcgatgtagcataatgaagtttgca

SEQ ID NO: 35139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttagggcacggcagcatgcattgtggagc

SEQ ID NO: 35140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttagtaatatcgattgttagtgttcgcca

SEQ ID NO: 35141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttatttggggttaactttcatggggagga

SEQ ID NO: 35142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttcaaaccccctgcaataagcgtctccac

SEQ ID NO: 35143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttcaggtccctcacggcggtgtgcgtttt

SEQ ID NO: 35144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttcccttgtgttgtaactgtggtgtggta

SEQ ID NO: 35145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttccgcgatgttcatgcagtgacagatgg

SEQ ID NO: 35146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttcctgatgcattatcattgtgtctccgc

SEQ ID NO: 35147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttcgagggtggcgagttctgtttctgccg

SEQ ID NO: 35148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttcgagtgcgaatttgttatgttgctgtg

SEQ ID NO: 35149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttcgccctactaacacgaaccgatgagcg

SEQ ID NO: 35150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttcggggggttgattgttcatggggtcgt

SEQ ID NO: 35151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttcgttaaccagatcccgacacatggcgc

SEQ ID NO: 35152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttcgttgatatcgcgtgggatatagggtt

SEQ ID NO: 35153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttctactcggatgctattgacacgcccct

SEQ ID NO: 35154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttctatggctagtaggcgcgggtcagggt

SEQ ID NO: 35155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttctcgtacgtactcgttgatggtgtttg

SEQ ID NO: 35156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttctgcggaaaattagaccgtttcggttt

SEQ ID NO: 35157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttctggcgcttctcagtgacttaccctgc

SEQ ID NO: 35158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttctgtgcacatggccacgaagttgggag

SEQ ID NO: 35159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttgacagggggtgtagagagaagcccgtt

SEQ ID NO: 35160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttgacagggtgttcgaatgcgccttagtt

SEQ ID NO: 35161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttgagctaagcatatcaaattgggtttcc

SEQ ID NO: 35162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttgaggggggcggatgatccacgatgaga

SEQ ID NO: 35163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttgagtcggccggacgtgtgctccggggg

SEQ ID NO: 35164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttgatccctgttggggtccgccctagtgc

SEQ ID NO: 35165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttgcagggcgttgggatggccttagcgag

SEQ ID NO: 35166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttgcattacgatgaccggcataagttaca

SEQ ID NO: 35167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttgcattctgagatgtttggagatgggtg

SEQ ID NO: 35168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttgccgcgaccaacctaaattggcgaagg

SEQ ID NO: 35169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttggacttggccttgtcggtaatagcgcg

SEQ ID NO: 35170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttggcggagacgttcatcggtttttgtgt

SEQ ID NO: 35171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttggctagatcaggcccagtatttctctg

SEQ ID NO: 35172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttgggcgaccggatacgatttcgacggaa

SEQ ID NO: 35173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttggtaaagctcgcagtgggttcgttcgt

SEQ ID NO: 35174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttggtttggggcggtgacgtcggtaaccg

SEQ ID NO: 35175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttgtaattgattggcggttaagatgggtt

SEQ ID NO: 35176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttgtggactttatcctgtgtgcgagttgt

SEQ ID NO: 35177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttgttagtctggtcctattcttgtatgct

SEQ ID NO: 35178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttgttatctccgttaccagaatcttctat

SEQ ID NO: 35179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttgttatgaggcatacctctaactcttgt

SEQ ID NO: 35180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtttaaagcgattaggcctgttcgggcgga

SEQ ID NO: 35181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtttacgcaacgttcgcttttactgaatcc

SEQ ID NO: 35182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtttacgtcgccgaaagctgcgttggctct

SEQ ID NO: 35183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtttactcttttctatccgacctgggagaa

SEQ ID NO: 35184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtttcaactacatggaatggttattcgcgt

SEQ ID NO: 35185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtttctaaggagtatcttggaagaatgctc

SEQ ID NO: 35186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtttctcccgattaacagagatggttagtg

SEQ ID NO: 35187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtttcttctgaggttcctatggtcaggcga

SEQ ID NO: 35188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtttgagactggaaggctcggttcatgcac

SEQ ID NO: 35189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtttgcgtaacgcagctaactcaccatacg

SEQ ID NO: 35190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtttgcgtcgtttcttcaccgatcgactaa

SEQ ID NO: 35191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtttggagcttcggcaggagttactgatgc

SEQ ID NO: 35192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttttctggtgagtcagccgcgtattatcc

SEQ ID NO: 35193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttttcttaactaggagcttctgtggtcga

SEQ ID NO: 35194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgttttggtgtcagtcacaaacgcaattaaa

SEQ ID NO: 35195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctgtttttgggcagggtaaattcagcatagta

SEQ ID NO: 35196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaaaacttcagtctgctacacccttccgtt

SEQ ID NO: 35197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaaaagcaatagaacgtattctgtccctcg

SEQ ID NO: 35198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaaaattatctcgaggaaacgcctttgttg

SEQ ID NO: 35199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaaaccatacctctcgtctgaggttattag

SEQ ID NO: 35200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaaacggttggtcggacatagagttactgt

SEQ ID NO: 35201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaaacttggttatgttccagtaagcaatcc

SEQ ID NO: 35202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaaagcacgtaaaatggagcggtttcgggc

SEQ ID NO: 35203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaaagcggagaatccccgattactgtagtc

SEQ ID NO: 35204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaaaggcgaaggcgccagtcttcccgtcga

SEQ ID NO: 35205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaaatccatgtgtggctatcggcgtccatt

SEQ ID NO: 35206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaaatggtcaaacgagaattccctatggtc

SEQ ID NO: 35207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaaatgtgtacaacatacggcgtgttgcgg

SEQ ID NO: 35208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaacagtgtaagtggctgggtaaccttaga

SEQ ID NO: 35209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaaccggcagtgtcgattcagtcacggttg

SEQ ID NO: 35210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaaccgtctacacaagcgtagaatcgggaa

SEQ ID NO: 35211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaacgggcaggtccggctcgatgcaacaat

SEQ ID NO: 35212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaacggggtattcccgctagtgtataggcc

SEQ ID NO: 35213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaacggggttgtcttggcgttacaatcata

SEQ ID NO: 35214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaacgtggaaagccgaggacatcaggccgt

SEQ ID NO: 35215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaactcattatgcagtcggttaaattgcca

SEQ ID NO: 35216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaactgaccacagaggttaatgtcacgctc

SEQ ID NO: 35217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaagacaggtccgggctaccgatgtaacca

SEQ ID NO: 35218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaagacatatctttgctcgatattattctc

SEQ ID NO: 35219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaagcacgctcttgttgccggtcaacaggg

SEQ ID NO: 35220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaagcactcctcatcccacgcctccccacc

SEQ ID NO: 35221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaagcagaaacatcgccactacagccgggc

SEQ ID NO: 35222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaagcatgccggtttttgttaatggacggt

SEQ ID NO: 35223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaagccaccgaatagtagctgccaggcatc

SEQ ID NO: 35224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaagcgctattgcacaattgtctgatcacg

SEQ ID NO: 35225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaaggcaacaaagggatgctggactgcggt

SEQ ID NO: 35226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaaggcgctaaataccaagccgcggcaatg

SEQ ID NO: 35227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaagtagcgcgggcatggatattgggtggt

SEQ ID NO: 35228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaagtcacggaactcattcggcggtgggga

SEQ ID NO: 35229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaagtgcttcgtgtgtatgtgtaacgtgtg

SEQ ID NO: 35230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaagtgggaagttcaaggtgttgccccttc

SEQ ID NO: 35231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaagttgtttgggtatgaacattcggttca

SEQ ID NO: 35232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaatacgccaaagcgattgttcttagtgtc

SEQ ID NO: 35233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaatacgcgtgtgtccggaaactgatgatt

SEQ ID NO: 35234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaatcaaacatactggatcaatagttttca

SEQ ID NO: 35235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaatcagcgcggacacgagttatttcctga

SEQ ID NO: 35236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaatcgttcatccttactaaatttatggag

SEQ ID NO: 35237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaatgcatgtcaggcgggcgccatgtgacg

SEQ ID NO: 35238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaatgctgatgctgcaagacacgtcggagg

SEQ ID NO: 35239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaattcggttggtctgtcgtgtagagtggg

SEQ ID NO: 35240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacaacgcgggacatacgggcccatcctac

SEQ ID NO: 35241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacacagcatcaactcgcccgtagtggtgt

SEQ ID NO: 35242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacacctcgcgcccctgtatcggtgggtga

SEQ ID NO: 35243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacacgctcccggtctcttgcttggccttc

SEQ ID NO: 35244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacacgggtgaagtattcgttgaagatctg

SEQ ID NO: 35245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacactaaagccgcgtatcctttggtgttc

SEQ ID NO: 35246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacactacaaagatcaacagccggacggcg

SEQ ID NO: 35247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacactgattgaccgagacgactgcaacta

SEQ ID NO: 35248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacagaactgagggtgtggaatttagttac

SEQ ID NO: 35249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacaggatgaactttcttcacgcttcaaac

SEQ ID NO: 35250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacagtcagcgcgggtgctgttcataatat

SEQ ID NO: 35251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacagttctgaggcagctggcggtgatcaa

SEQ ID NO: 35252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacatccccagcttctagggaggagtatta

SEQ ID NO: 35253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacatgccacggtacacggggcattcgtct

SEQ ID NO: 35254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacatgttcccacccctctaagtacggccg

SEQ ID NO: 35255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacattctcgcgtagtaactcccagtaagc

SEQ ID NO: 35256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaccaagtactgagcagctcaatgtggctg

SEQ ID NO: 35257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaccatgactctgcttgagacatcctacgc

SEQ ID NO: 35258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacccaaacgaagaggcagagttgcccgcc

SEQ ID NO: 35259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacccctttgtgcacttcactggccctgta

SEQ ID NO: 35260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaccctgcctgcgagagcattaggtaccgg

SEQ ID NO: 35261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacccttacgtcaagtgcaagattagattc

SEQ ID NO: 35262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaccgcctgctgatcgtttaggccttctgt

SEQ ID NO: 35263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaccgcgttccagggtctatggttttcccg

SEQ ID NO: 35264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaccggaccgttaaccttataatgggccta

SEQ ID NO: 35265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaccggtcgggcgtgtctaccttgctaata

SEQ ID NO: 35266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacctagttatggggttggaacacagagaa

SEQ ID NO: 35267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacctgaattatattcgcctccagccttac

SEQ ID NO: 35268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacctgggcactaatttgtagctgcgatct

SEQ ID NO: 35269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacctgtctcgtaaacaggccatactgtta

SEQ ID NO: 35270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaccttttgttgttaggtgacgcgacgcta

SEQ ID NO: 35271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacgaattgacgggggaaatggtgtgtaaa

SEQ ID NO: 35272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacgacggcgttttagaaaggtcttggctg

SEQ ID NO: 35273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacgaggtgttggtgacaatggatcccgta

SEQ ID NO: 35274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacgatatccctgactaaaacagtaatcgt

SEQ ID NO: 35275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacgatcaagggaaaagtgcttggaagagg

SEQ ID NO: 35276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacgattagccattcttgggtctgtgatgt

SEQ ID NO: 35277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacgctgcaaagcccttccacgcggagttg

SEQ ID NO: 35278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacgctgtcacctccctcgaattgcctgat

SEQ ID NO: 35279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacggccctcatattctctcccctctcatt

SEQ ID NO: 35280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacgggcggtgaggggcctaaggagggcgg

SEQ ID NO: 35281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacgggtctcccaacttctcagtgatctat

SEQ ID NO: 35282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacggtcgtgatatccattattgtacatag

SEQ ID NO: 35283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacggttagacccgtgtcccttgagcctcg

SEQ ID NO: 35284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacggtttggtctacggtgaatgtttgcta

SEQ ID NO: 35285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacgtcgacactccgtacgcttctactctt

SEQ ID NO: 35286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacgtctatccggtttttaggacatagact

SEQ ID NO: 35287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacgttagttccgccctgggagcggaatcg

SEQ ID NO: 35288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacgttctccccatatcggataaaaccggt

SEQ ID NO: 35289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttactaccggcggaccttgctgtctatggtc

SEQ ID NO: 35290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttactagattcgggaatgcgacttacgcacg

SEQ ID NO: 35291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttactagtttttcctgttatcgaccaacttg

SEQ ID NO: 35292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttactatggtcggtactacgtccattcgaga

SEQ ID NO: 35293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttactccgaatgccagtccacttcaaatcat

SEQ ID NO: 35294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttactccgattagtctcccctcggaaacgat

SEQ ID NO: 35295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttactcctgctgcgtatgggggctccaagcg

SEQ ID NO: 35296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttactcgattaatgcgtatacatgggcgcgg

SEQ ID NO: 35297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttactcggttgtgccggcatgtcaatcgtgt

SEQ ID NO: 35298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttactcggtttatagtttcgccatccgtgac

SEQ ID NO: 35299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttactgataacctcacaacacctgtgtgtgt

SEQ ID NO: 35300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttactgctgggccccgttatactgtcactgc

SEQ ID NO: 35301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttactgctttgtcttttgatggtgcttttcg

SEQ ID NO: 35302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttactgggctaatcagcatcgcacgccatag

SEQ ID NO: 35303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttactggggagcgaaccatgcgtctccgcta

SEQ ID NO: 35304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttactggggggacttgagttacgctggcccg

SEQ ID NO: 35305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttactgtgctacttcggcatttttgccaaca

SEQ ID NO: 35306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacttaatcattagaaagactccgtgtact

SEQ ID NO: 35307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttacttcccatggaagcgtttccctacggtt

SEQ ID NO: 35308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttactttgtagatagtggtaaccctatcact

SEQ ID NO: 35309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagaatacctgaggcgcacgattatggcgg

SEQ ID NO: 35310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagaattatgtgtgtgtcctgttgtatcta

SEQ ID NO: 35311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagacaagcaggctcttaatgcggtatgtt

SEQ ID NO: 35312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagacatgatgcacattctacgctcccagc

SEQ ID NO: 35313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagacattcaagtcaaaagattgatcctgt

SEQ ID NO: 35314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagaccaaggaaataacatcgacattgcgc

SEQ ID NO: 35315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagacgcatcgtcttttggagcgagcatgt

SEQ ID NO: 35316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagagaaataacccgggtcgaaggcgagac

SEQ ID NO: 35317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagagccattcgcatcgggagtaggcacgg

SEQ ID NO: 35318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagagcttttttattgcgcagtccacctgc

SEQ ID NO: 35319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagagggaaaacgtttcgtaggcattgttg

SEQ ID NO: 35320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagagtgcaggtggtgattttcgggttgat

SEQ ID NO: 35321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagattatctgctcgttaaagattctttgg

SEQ ID NO: 35322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagcaacagttgtcgctttcatcgtgtctc

SEQ ID NO: 35323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagcagagattcatagtctacccaccgact

SEQ ID NO: 35324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagcgaatccgatctacacatcttcgttgg

SEQ ID NO: 35325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagcgcaggatttctgtttttgttcattat

SEQ ID NO: 35326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagcgcctcctttttgggtatggcaagcgc

SEQ ID NO: 35327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagcggcaccttaaaactcccgtttacacg

SEQ ID NO: 35328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagcgtacaaaattggcgactacccactat

SEQ ID NO: 35329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagcgtacgggttgtttcacgctctataac

SEQ ID NO: 35330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagctagagtaatcggaatctttgattttg

SEQ ID NO: 35331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagctgagaacttatcacattttaagcgtg

SEQ ID NO: 35332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagcttaccctgcgtcatctctaaaggtta

SEQ ID NO: 35333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaggaagtccagcacggaaggcgcatggtg

SEQ ID NO: 35334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaggaattcagtgttagcgggctggtcgta

SEQ ID NO: 35335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaggcacccaatttttctttctgcgttggt

SEQ ID NO: 35336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaggcaggtggacggctcattcatgtcggg

SEQ ID NO: 35337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaggcgtgcgagaaaaccatagtgagcttg

SEQ ID NO: 35338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaggcgttgtggtatagagcgtggggcctc

SEQ ID NO: 35339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagggacagtacgttcctggctctttggta

SEQ ID NO: 35340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagggatttaacacgtttgtctcctccccg

SEQ ID NO: 35341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagggcctcggaatgcgcgtgacattccta

SEQ ID NO: 35342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagggcggaacttatcccatcgcgtgacaa

SEQ ID NO: 35343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagggctgggggtggaagggcacaaagagg

SEQ ID NO: 35344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagggggcaatcggggggtggcctggtgga

SEQ ID NO: 35345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagggggtaaggccaaacaacatttgctca

SEQ ID NO: 35346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaggggtaacgtgtgacgtcttggttgcga

SEQ ID NO: 35347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaggggtcactgcataggtcgaccctgctt

SEQ ID NO: 35348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagggtacagcatgccgtaacagacctcgt

SEQ ID NO: 35349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaggtactgaccccacgagcggcgattttc

SEQ ID NO: 35350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaggtcacacacgcatgtatgagcaggctt

SEQ ID NO: 35351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaggtcggtacgtcgagccggagaactgac

SEQ ID NO: 35352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttaggtcgtaaccctgtgagtgtgtcatatt

SEQ ID NO: 35353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagtagcgtgcgaacagatgtcggctatgg

SEQ ID NO: 35354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagtatgacatgggatcccgctataataat

SEQ ID NO: 35355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagtcacaaggcacgaggagtaggtgtccg

SEQ ID NO: 35356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagtcagctgccgggtagcacacaaaattt

SEQ ID NO: 35357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagtccccgaaataggcgttagtaaacctt

SEQ ID NO: 35358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagtgaccgcgtttccgccttccacttgcg

SEQ ID NO: 35359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagtgatttcttgctggcgcttgaacggga

SEQ ID NO: 35360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagtggggtgttccgtcacttttacagccg

SEQ ID NO: 35361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagtggtcaatcacagtaacagctccaggt

SEQ ID NO: 35362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagtgttctttacccgctcggaaggcgtcg

SEQ ID NO: 35363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagtgtttgactacgtctattctggatttg

SEQ ID NO: 35364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagttcacgacgacctatgcatcgctgccc

SEQ ID NO: 35365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttagttgcggggcctacgtaactttagtgcc

SEQ ID NO: 35366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttataatgtgagaatgggcaatgttccaagt

SEQ ID NO: 35367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatacttatttagccggtgcccgtaatttt

SEQ ID NO: 35368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatagagggctatagcggtgcgcgtgcctg

SEQ ID NO: 35369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatagcacgcgaatgctagggtttacgagg

SEQ ID NO: 35370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatagcccgtccacgtccatatttccgagt

SEQ ID NO: 35371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatagcgaccttgatgcccctgtcctgacc

SEQ ID NO: 35372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttataggtcaagcagattgagacactctcac

SEQ ID NO: 35373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatagtacttgtacagcaacgtgtgtggga

SEQ ID NO: 35374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatataaccagctgggggcgaagaaccgcc

SEQ ID NO: 35375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatatcaccggatctccttttgttaacgtg

SEQ ID NO: 35376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatatcccatcagtccttccaggcgttctc

SEQ ID NO: 35377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatattgacatggaaagcggcagtagatat

SEQ ID NO: 35378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatcatacatgccgtgatgggtggttgttt

SEQ ID NO: 35379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatcatgtgtcgacatcacgaatgcgtccc

SEQ ID NO: 35380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatcccacttgagatcaagcgatcgcggtt

SEQ ID NO: 35381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatcccataaggtttcgagggccctattac

SEQ ID NO: 35382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatcccggttttggccgtagattgataagc

SEQ ID NO: 35383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatccgcacacagtacgcgttcctctgcgc

SEQ ID NO: 35384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatccgcgggtatagttggcgtttacttct

SEQ ID NO: 35385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatcgacgggttaaaataatggcctgtctt

SEQ ID NO: 35386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatcgcagtctttatccagatcggccacca

SEQ ID NO: 35387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatcgcgcacagggaggtatagtaccctca

SEQ ID NO: 35388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatcgtatgggatgtggttatggcgaagtg

SEQ ID NO: 35389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatcgtcaccagagttatgtagacagcgac

SEQ ID NO: 35390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatctcgttgaaggtagtgtatgtttggaa

SEQ ID NO: 35391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatgaatcccggacgcgtcacgttttctgg

SEQ ID NO: 35392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatgacggcccggactagtgtggcatacgc

SEQ ID NO: 35393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatgataaatgcgctttctcggcctgggtg

SEQ ID NO: 35394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatgatacgatgggtacttagcttgtgggt

SEQ ID NO: 35395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatgcacatggttgtaggtgttcattccca

SEQ ID NO: 35396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatgccgcgtgcgggtggatccaggattgc

SEQ ID NO: 35397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatggatcgttaatcaaagtcgctattacg

SEQ ID NO: 35398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatggcaacgtataatacggttcttgcctc

SEQ ID NO: 35399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatggtccgcattctgccgctcgtgaagtt

SEQ ID NO: 35400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatgtcagattcttcggcgattttggatta

SEQ ID NO: 35401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatgtggccaaggcgaaggaaaggaggccc

SEQ ID NO: 35402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttattacatgacacgggtggctttagtcgcg

SEQ ID NO: 35403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttattatgatgtgcagtcggggcttgtgccg

SEQ ID NO: 35404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttattcacatgcactcgcaactatttggatc

SEQ ID NO: 35405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttattccgtcttgtaccaggagactctcgtt

SEQ ID NO: 35406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttattgaatttttttatctgtgggggttgtg

SEQ ID NO: 35407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttattgcggctttgtaccttcgggtctcggt

SEQ ID NO: 35408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttattggtcgtttaggccagctgggtacaag

SEQ ID NO: 35409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttattgtcatcggccccgccacttatcacgc

SEQ ID NO: 35410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatttactcagcattcctcgggtgtctcgg

SEQ ID NO: 35411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatttacttaggctagcatttttcacggga

SEQ ID NO: 35412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatttcccccagaccgactaaggaccgtgc

SEQ ID NO: 35413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatttcttcaccttgagtgtgaccctaggt

SEQ ID NO: 35414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttatttgtgcttccgtcatccgtctggcctg

SEQ ID NO: 35415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcaaacggtgcaattccgatcgcaggatgc

SEQ ID NO: 35416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcaaccctcgatcaaaggccagcatgttgt

SEQ ID NO: 35417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcaaccggggtacgggagctgtggcatggc

SEQ ID NO: 35418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcaacgagcgcgtaatctggcactccgcac

SEQ ID NO: 35419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcaactacaaggaacgctacttgtttagca

SEQ ID NO: 35420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcaagctagttcgtgttcgaagttttaccg

SEQ ID NO: 35421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcaaggagctttcggtaggaactcacgttg

SEQ ID NO: 35422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcaagttgatcgcttataccattcaaggaa

SEQ ID NO: 35423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcaatgacgaacatagttacgtacgtgcct

SEQ ID NO: 35424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcaatgagcgttccccgggtagtgctgtgc

SEQ ID NO: 35425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcaatgggtttggtactcaattaagtcgtt

SEQ ID NO: 35426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcacaccgtgttcggacctgttgcagctcg

SEQ ID NO: 35427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcacaggatggagtgcgggcggtactctgt

SEQ ID NO: 35428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcacattccaaggacggttggggtttgtgg

SEQ ID NO: 35429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcaccacctcattgttcaacttgttaaata

SEQ ID NO: 35430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcaccgcttactcacaagtccccttgccgt

SEQ ID NO: 35431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcaccgtatcacacggttgcatctttggag

SEQ ID NO: 35432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcacctggctgttagagatgggatctagtg

SEQ ID NO: 35433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcacgactcgcagttgcgtgggagtgacgc

SEQ ID NO: 35434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcacgagcacatccagccccttcgggacga

SEQ ID NO: 35435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcacgagtctcaagcgtagtgcattagatg

SEQ ID NO: 35436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcacgatcttgtagctaaacgagggctgac

SEQ ID NO: 35437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcacgcagcggtctggtaatgtcccatgtg

SEQ ID NO: 35438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcacgcgaatggggcgtctatgcgatacgt

SEQ ID NO: 35439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcacggaaaagatggcattttgctggtttt

SEQ ID NO: 35440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcacgggtgtgtcttgactcaacggtcacg

SEQ ID NO: 35441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcacgtgcgcacagtggggttgctattgtc

SEQ ID NO: 35442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcacgtgtcctcgccgtccggatgatcgct

SEQ ID NO: 35443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcactaactcacgaggggtatctgtgcaga

SEQ ID NO: 35444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcactacgcccatcaggagcgagatgcggt

SEQ ID NO: 35445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcactatctcgggtgtccgtttcttgctca

SEQ ID NO: 35446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcactgatatcgagtagggcgactattcaa

SEQ ID NO: 35447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcagacggtgccccgaaaatatgcttaaat

SEQ ID NO: 35448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcagaggctttatcgtcatactcaccggag

SEQ ID NO: 35449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcagcagttacttagcacgggtcttctcgt

SEQ ID NO: 35450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcagcgcaggacgacttcctctcaggactg

SEQ ID NO: 35451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcaggcggcccctgtagggtcttgatagga

SEQ ID NO: 35452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcagggtgtggcctttcccaaaggaatgat

SEQ ID NO: 35453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcagggtttatatactgctgattcgtcgac

SEQ ID NO: 35454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcagtcaatagatgcaagcgagatcgggtc

SEQ ID NO: 35455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcagtcattcggctcgtcccgccacttact

SEQ ID NO: 35456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcagtccggctcgagtctatggagagttag

SEQ ID NO: 35457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcagtcgagtaatttctatcctactgtgag

SEQ ID NO: 35458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcagtgaagtgcaaaattggaggttagcct

SEQ ID NO: 35459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcagtgcgttcacgtctttccggcttcggc

SEQ ID NO: 35460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcagtggagacttccaacattggtcttgtc

SEQ ID NO: 35461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcagtggcgcaaaaagtgcattaaactatg

SEQ ID NO: 35462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcagttgtcccgcttccgatggtgttggcc

SEQ ID NO: 35463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcataatagccttcccccggactgattggt

SEQ ID NO: 35464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcatcaacaacgcgcgttccactttatggg

SEQ ID NO: 35465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcatcgttccttatatatgctatcttctcg

SEQ ID NO: 35466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcatgacccaacatgtcctgaacttcgctg

SEQ ID NO: 35467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcatgcgattccacgatgtggacgggcgcg

SEQ ID NO: 35468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcatgtatgatagtttatcggaggggatat

SEQ ID NO: 35469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcatgtctttaactagcatcgttccgtggt

SEQ ID NO: 35470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcatgttgccatggctgggcgtgcgggcgc

SEQ ID NO: 35471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcatgttttgcacctgtacccggggtaagc

SEQ ID NO: 35472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcattccgtgatgttggtacgttggtttcg

SEQ ID NO: 35473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcattgtcattggtagaactttgtgtatcc

SEQ ID NO: 35474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcatttcccggtaccatagttttagaactt

SEQ ID NO: 35475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcatttcgcgcatgtgggattcactcgatg

SEQ ID NO: 35476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccaaagggatggtagtcctgtagcgtcgc

SEQ ID NO: 35477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccaattaggaaagctttgttctccactgc

SEQ ID NO: 35478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccacccgggagggattctcgacacctcat

SEQ ID NO: 35479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccaccggggttgcacagcatgtccgccaa

SEQ ID NO: 35480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccacttcgacctagtaatagggttaaata

SEQ ID NO: 35481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccactttggattatccccgtgggctggtt

SEQ ID NO: 35482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccaggtacgcaagcaggcggtaacacgga

SEQ ID NO: 35483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccatgttctcatgtcgtaccggtacgccg

SEQ ID NO: 35484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccatttaataacggcaacgcttagccttt

SEQ ID NO: 35485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcccatacccggctcgttggctaatccatc

SEQ ID NO: 35486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcccatcttcatctcggaggtcggaggtat

SEQ ID NO: 35487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcccattattcgctggattttactttgtgg

SEQ ID NO: 35488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcccattggatcctacttccttagcgtgca

SEQ ID NO: 35489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccccaccgaccaagtatcaatggcatctg

SEQ ID NO: 35490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccccatggatccatgtttgtatccgaacc

SEQ ID NO: 35491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccccctattggtatcacggtgtttcgacc

SEQ ID NO: 35492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccccgacgccttaaagagcgtgaggcagg

SEQ ID NO: 35493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccccgtgacgtcagagccggtctcgtcgt

SEQ ID NO: 35494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcccctaacacgagaaccttacaaggacta

SEQ ID NO: 35495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcccctggtaccgagctgcacatcacaggc

SEQ ID NO: 35496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcccgatccgcattacgcacatgggcctgc

SEQ ID NO: 35497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcccgattgttctcgattgcgaggctaccc

SEQ ID NO: 35498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcccgccactcggacacagtcgttgccagg

SEQ ID NO: 35499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcccgcgcatcacttaccgcgtggtcatcg

SEQ ID NO: 35500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcccggctcttgaccgcgaactgtgaaggc

SEQ ID NO: 35501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcccggggatgcatcacaagaatggtcccg

SEQ ID NO: 35502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcccgtggtcttaaccctgattggtatgat

SEQ ID NO: 35503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccctaatcgcaagtcatgcaacgaaagcg

SEQ ID NO: 35504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccctcgcttagctagtagttgggtggtat

SEQ ID NO: 35505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccctcgtcgaggtgcgcgattcctctgat

SEQ ID NO: 35506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccctcgttgatgacttgtgtggcccgctc

SEQ ID NO: 35507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccctgaatcttcggtaggtacgtcctgtc

SEQ ID NO: 35508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccctgctgatacatctcccgctgcaatgc

SEQ ID NO: 35509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccctgtcgtgcagctaggaatgccagtgt

SEQ ID NO: 35510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcccttctccgatcgtgtggcgggacacgt

SEQ ID NO: 35511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcccttctctttttgtatcttgacggcgac

SEQ ID NO: 35512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcccttgccaattcgttctgccgtggcgcc

SEQ ID NO: 35513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccgaccgcgccctggcggatacctccgct

SEQ ID NO: 35514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccgagaagatcccctaagggcatatcacc

SEQ ID NO: 35515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccgattctctgcatgcctggccgcgccgt

SEQ ID NO: 35516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccgcgccagcaaatgatgttacggatacc

SEQ ID NO: 35517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccgcggaatcgtgctcgtgggattacacc

SEQ ID NO: 35518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccgctccgatatatttttgcacccgttac

SEQ ID NO: 35519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccggtgcttcagggtatggaagtgaaggg

SEQ ID NO: 35520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccgtaataccagcggtgtgttcggatggc

SEQ ID NO: 35521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccgtaccgggctttacgtgtaatcatcgc

SEQ ID NO: 35522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccgtccctgttaatcacgtgttagtagct

SEQ ID NO: 35523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccgttctggatgttgggttcattatccgg

SEQ ID NO: 35524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccgttttatgttgctgtttcgaattgtaa

SEQ ID NO: 35525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcctacatgttcattgttacggcggttatt

SEQ ID NO: 35526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcctatcggccccgctcatatttgctgatt

SEQ ID NO: 35527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcctcaacctttttagctcagaacctccct

SEQ ID NO: 35528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcctcagacgcatccgggtagcccgacttc

SEQ ID NO: 35529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcctcatcccacggatggcacggttggttt

SEQ ID NO: 35530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcctccactttcccgcatctaccaagtttt

SEQ ID NO: 35531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcctccgacctcctcgcgaccccccgtttg

SEQ ID NO: 35532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcctcctggcaggtctaactgcgagtctct

SEQ ID NO: 35533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcctcgcgtttgacggcagtcgtactgcgt

SEQ ID NO: 35534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcctcggggtgtatttaactgggttatgac

SEQ ID NO: 35535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcctgcagactaccaagcggtacccacatt

SEQ ID NO: 35536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcctgctggatttgatatatgtatgcttat

SEQ ID NO: 35537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcctggaggcaatgttatttgacgctctcc

SEQ ID NO: 35538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcctggccaaaaccagccgcacatcttgct

SEQ ID NO: 35539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcctggtttggctacttggctcggctgttg

SEQ ID NO: 35540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccttaccgtaggcttcgcgtaaacgcggg

SEQ ID NO: 35541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttccttgatattattcggccggaattcagcc

SEQ ID NO: 35542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcctttctgtgattgtgacgccctttaggc

SEQ ID NO: 35543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgaaacagatctacagcggtgcaattgaa

SEQ ID NO: 35544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgaaagtacgaggggaaacccgtcggccg

SEQ ID NO: 35545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgaagcggggatctgtctgcctgtacgat

SEQ ID NO: 35546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgaagctaacggtgaaatgggataggtgt

SEQ ID NO: 35547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgaccattcacggactaatatttagcctt

SEQ ID NO: 35548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgacgataagttgtgcgttgatgcgtcgc

SEQ ID NO: 35549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgacggctggctctcacttggtggggaac

SEQ ID NO: 35550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgaggctatgtcatattgcacgccacatg

SEQ ID NO: 35551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgagggtcagctggcgatttaatgataag

SEQ ID NO: 35552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgaggtgaagggcccgtctcggttcgtgc

SEQ ID NO: 35553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgaggtgcttcaatttacaatttctgtgg

SEQ ID NO: 35554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgaggttggccaaggttagcacaggtgtc

SEQ ID NO: 35555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgatcaagatattgccaccttgcttcact

SEQ ID NO: 35556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgatggttgtgcggaatccataaaagtga

SEQ ID NO: 35557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgattactcgacatgcgatagtattcgtt

SEQ ID NO: 35558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgcaactcgattcgggctctatcaggggt

SEQ ID NO: 35559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgcgctgcaggggcgaccatcttgtgttt

SEQ ID NO: 35560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgctccccacgatcatagcaactgttgtc

SEQ ID NO: 35561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgctgtctaaatccactcaatgtgccaga

SEQ ID NO: 35562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcggaaattctttgttgtgaatcttgtgcg

SEQ ID NO: 35563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcggaaggaggagtaaagctgtacttccgc

SEQ ID NO: 35564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcggaatcggcgcgaccctggtgagcactg

SEQ ID NO: 35565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcggacgggatgcctctccgttgcgctcca

SEQ ID NO: 35566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcggattcgggtggatctctatccagtgag

SEQ ID NO: 35567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcggattttgcccgctttttgccgatactg

SEQ ID NO: 35568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcggcgaaaccgtcgcatctgggtgttgtc

SEQ ID NO: 35569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcggcgacgggggtgcacattcggtggggt

SEQ ID NO: 35570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcggctgcctctctttctctggtccatcgc

SEQ ID NO: 35571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcggcttccaagcaacctatggcaactccg

SEQ ID NO: 35572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgggacgaggcgtgtagggtcctagcggc

SEQ ID NO: 35573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgggacgatcgcccgcttcatgtgggttt

SEQ ID NO: 35574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgggatcttcgggattgtgccgtaacatg

SEQ ID NO: 35575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgggctccgggacggatccactggtttcg

SEQ ID NO: 35576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgggtatgggctatcgattgcgtgattcc

SEQ ID NO: 35577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgggtgctgaagaggccggtgaaatcccg

SEQ ID NO: 35578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcggtgttatgcgtgcttcgcgatcttggg

SEQ ID NO: 35579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgtaagtccacgccgcgcttgttttaccg

SEQ ID NO: 35580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgtaggactcgttctcaataatctctggt

SEQ ID NO: 35581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgtcggagatttcggcgtaacaaaggttg

SEQ ID NO: 35582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgtctgtcggcaggcgagggtagacccta

SEQ ID NO: 35583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgtgctattgttatcggtatgctcgttca

SEQ ID NO: 35584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgtgggatagaccaacgtctgctcagact

SEQ ID NO: 35585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgtgggtagaataagaacccgctgtgtgc

SEQ ID NO: 35586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgtgtaagagcggtggtggggaagtcttc

SEQ ID NO: 35587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcgttagtatgtgattcttccctattggtc

SEQ ID NO: 35588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctaccgagagcatcaggggccgactacgg

SEQ ID NO: 35589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctacgcggttcctggcaggctcattggca

SEQ ID NO: 35590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctactgcggaacgatttaggggaaccatg

SEQ ID NO: 35591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctagagagcggatcagcgccatatcttcg

SEQ ID NO: 35592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctagaggttgttacaaaaggggatgcggc

SEQ ID NO: 35593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctagcgggcgttggctattacctgctggc

SEQ ID NO: 35594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctagctgccaacctgtgccacatgcggtc

SEQ ID NO: 35595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctaggcttagtcacgctttaacgtctcct

SEQ ID NO: 35596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctatcacggtgggtgtttgggaggctcta

SEQ ID NO: 35597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctattgcgtcggggactggcaatgtatgc

SEQ ID NO: 35598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctcaatactttctactcgctgtatcaatg

SEQ ID NO: 35599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctcactccatggcagaggcgaggtcagcc

SEQ ID NO: 35600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctcagaacttgtcagctcacgagaaagcc

SEQ ID NO: 35601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctcagggccggacgctctaacatctcgat

SEQ ID NO: 35602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctcccccactaattcccctagtgccattg

SEQ ID NO: 35603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctccccgaggatttctttattttcttaat

SEQ ID NO: 35604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctccgtgggatcaaactggttcgggttct

SEQ ID NO: 35605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctcggtccgattgcgcaaatacatcccgt

SEQ ID NO: 35606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctcgtcaattcctcacgattgcttgttac

SEQ ID NO: 35607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctcgtcggcgctactttcagttaaggatc

SEQ ID NO: 35608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctcgttggcagtcttgacggctggaatgg

SEQ ID NO: 35609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctcgtttagtccctcctcgcgcgtaggtt

SEQ ID NO: 35610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctctgtgctaactgtttgatgctttggcg

SEQ ID NO: 35611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctcttcagctccggtccattaaacgcggt

SEQ ID NO: 35612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctgaagaactgcggcggggttgtcggttc

SEQ ID NO: 35613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctgaatagacttggttttacgtggtagcg

SEQ ID NO: 35614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctgaattcacactgggctatttatgacgc

SEQ ID NO: 35615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctgcggtttcggtgtatcctccgaggttg

SEQ ID NO: 35616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctgcgtcgggatcgaactagtgaatctcg

SEQ ID NO: 35617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctgggccgtgtggcgcggtattcgtcacc

SEQ ID NO: 35618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctgggtcttatcaatcactcccgtagact

SEQ ID NO: 35619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctggtgcgtcttttagcgaggcaagagct

SEQ ID NO: 35620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctggtggtgtatagtatacagacggcttc

SEQ ID NO: 35621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctgtcacattttgctgatctcatcgtgct

SEQ ID NO: 35622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctgtggctgaataaagacgtcactagcca

SEQ ID NO: 35623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctgtgtaatgtcacattgatctggctcct

SEQ ID NO: 35624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctgttctcgaagtgactgcgaaccgtttc

SEQ ID NO: 35625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctgttgggtagctgaatattatgcaccaa

SEQ ID NO: 35626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcttacacccatgtccttccactgttgctg

SEQ ID NO: 35627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcttagttacattagggaggcctgcgcacc

SEQ ID NO: 35628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcttcaatatccctggcggtcggcactcga

SEQ ID NO: 35629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcttcactcataacacctgtgcgtagaccg

SEQ ID NO: 35630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcttcgtgcgttaactagttttgtcttcta

SEQ ID NO: 35631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcttgcagtcgaatagacacttttttgctt

SEQ ID NO: 35632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttcttgccgtagaggcaaatctgcggtcgac

SEQ ID NO: 35633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctttacgctccggtctagggtcccgatgg

SEQ ID NO: 35634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttctttggcccgcaacacccattggcatgac

SEQ ID NO: 35635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgaaagatagagccgcccgaaggatcgctg

SEQ ID NO: 35636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgaaagtatcctagccgatcgcgggcgacc

SEQ ID NO: 35637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgaaccccataagtttgtggaggagtttat

SEQ ID NO: 35638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgaacggcgtcttgacgatacttgggcttg

SEQ ID NO: 35639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgaacggtcagtattcacctccggctcggc

SEQ ID NO: 35640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgaactggtggaacgtctgtccggtggggc

SEQ ID NO: 35641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgaagatgttgtcgcgtttgttcctctgtt

SEQ ID NO: 35642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgaagcagttaacatctgagcataagccca

SEQ ID NO: 35643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgaagtgcttttgatcgtcatgcttctgcg

SEQ ID NO: 35644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgaataccgttaagtaataacatgcgtgat

SEQ ID NO: 35645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgaatgattgaagttgggcctttggtccac

SEQ ID NO: 35646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgacacttgccagagtggttctcatgtgga

SEQ ID NO: 35647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgacagatgtgatgagtgtcgcccattctc

SEQ ID NO: 35648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgaccgagtccggtttggtggggatgtcca

SEQ ID NO: 35649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgaccttgtgggatgtgaggcgcggcccac

SEQ ID NO: 35650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgacgaaaggagggggcgcttgcggcggtg

SEQ ID NO: 35651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgacgctttcgattagccctatactctcct

SEQ ID NO: 35652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgactacgactttcatgcgcactacagggt

SEQ ID NO: 35653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgactcacaagcggacggatcttatagctc

SEQ ID NO: 35654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgactcgctctctcctgctggtccgcttaa

SEQ ID NO: 35655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgactggctacttagcatagccggtgcacc

SEQ ID NO: 35656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgactgtctagttgttcgtacaaggtagat

SEQ ID NO: 35657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgagaatggcgtattaggtcctatctcgct

SEQ ID NO: 35658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgagagtgccgcgtggaattggttaggtgt

SEQ ID NO: 35659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgagatagggaccgtcagggaccgtcgccc

SEQ ID NO: 35660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgagatgcggtcccagtaaattctttctga

SEQ ID NO: 35661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgagcaagattcttttgtcggttattcgac

SEQ ID NO: 35662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgagcaccacactgtctcctccgtcaccgt

SEQ ID NO: 35663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgagcaggatgtgttacgcacggtctgatg

SEQ ID NO: 35664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgagcatgcgacacgtccagctttgtaggt

SEQ ID NO: 35665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgagcctcgcaagataaccgatccctcgtc

SEQ ID NO: 35666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgagcctgggcgggtgccgaaacatttccg

SEQ ID NO: 35667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgagcgactactccggcttacagtttgtcg

SEQ ID NO: 35668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgagcgcgttaatgcagaaagcagcttatg

SEQ ID NO: 35669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgaggctatggatcctatgcctcacgaagc

SEQ ID NO: 35670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgaggggattgccgcgtgtcaaacgaggtt

SEQ ID NO: 35671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgagggggtataggttagggttgtatgggt

SEQ ID NO: 35672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgagttcaatcaagtactgtttgcattctc

SEQ ID NO: 35673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgatcatgttccgaggaccgttcatccagg

SEQ ID NO: 35674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgatctgcttttccacctactgatttcggg

SEQ ID NO: 35675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgatgctgattcactggctgatcggtcccg

SEQ ID NO: 35676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgatggcatgcatgcgaaatcaccactaac

SEQ ID NO: 35677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgatggcgtttaccggtacacttgcaacac

SEQ ID NO: 35678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgattatctgccgaagagtttggtgaagga

SEQ ID NO: 35679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgattgagtggtgcgaaatatgtccccccc

SEQ ID NO: 35680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgatttaacttggcgactgcggtggggttt

SEQ ID NO: 35681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcaacatctgttagtgtgtataattgtgc

SEQ ID NO: 35682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcaacggtccactatcgcctttcagctta

SEQ ID NO: 35683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcaacgtggtatcttatcgcctccatgta

SEQ ID NO: 35684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcaattgtccggcatccacagttggctta

SEQ ID NO: 35685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcacacctagacttcgtggttcccttaac

SEQ ID NO: 35686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcacacctggcggtctcttgtctcgaact

SEQ ID NO: 35687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcacacgccatctagctttcgtggtagct

SEQ ID NO: 35688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcacactccaggtaccaggggcagaagtg

SEQ ID NO: 35689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcacaggctgattaactcgtcgttattat

SEQ ID NO: 35690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcacgattcgacttccaccctgggttcgc

SEQ ID NO: 35691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcacggtatagggtcttctacaatcgaca

SEQ ID NO: 35692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcacgtataaacggccatatacaagacga

SEQ ID NO: 35693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcagaatcatgagctccattgttagtgaa

SEQ ID NO: 35694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcagaggggtgaaccgcggctcgggttgg

SEQ ID NO: 35695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcaggcagaggcgtgaaaggcattaatga

SEQ ID NO: 35696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcaggctgggtatggatctgcaaaggttt

SEQ ID NO: 35697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcagggagtacggactgtcttaatctgtt

SEQ ID NO: 35698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcagggattggaggttgaccggagtgggt

SEQ ID NO: 35699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcagggcgagcacgaagcggatcggacgc

SEQ ID NO: 35700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcatacgacactggggttgcgaatcgtcg

SEQ ID NO: 35701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcatgccgcagtcgacaagctgctaacga

SEQ ID NO: 35702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcatgtttccggcatcgcggtgttatgga

SEQ ID NO: 35703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcattacgaacccttcttgcactttgcct

SEQ ID NO: 35704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgccaccgatttggtgcaccagaaactcgt

SEQ ID NO: 35705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgccaggaggtcagacgacttgggcatggg

SEQ ID NO: 35706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgccagtaacgcgccgatttagacacatga

SEQ ID NO: 35707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgccatcgcactatgccggtagggggcact

SEQ ID NO: 35708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcccaaggcgacttccccttgcgacccca

SEQ ID NO: 35709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcccagcttccgcgccctaacggcggact

SEQ ID NO: 35710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgccccgtaggggaaccggagataggcatc

SEQ ID NO: 35711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgccccgtctttggtggcacttcaggcatt

SEQ ID NO: 35712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcccttgcaggcttggccgcttatggttg

SEQ ID NO: 35713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgccgaacgttagatagtgtagagtaatca

SEQ ID NO: 35714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgccgacatatggattctacatccatcgaa

SEQ ID NO: 35715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgccgcagtattgctgcttcgtgctccgcc

SEQ ID NO: 35716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgccgtcccgcaagtttgaatatgagactc

SEQ ID NO: 35717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcctgcactactctctagtggctgtgata

SEQ ID NO: 35718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgccttgccttacttgcggcaggttactta

SEQ ID NO: 35719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcgaaccattcaactggcgcattagctga

SEQ ID NO: 35720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcgaacgttgaacagtatagacctgcacc

SEQ ID NO: 35721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcgaagtgcgggtgtgatgctgctcgagt

SEQ ID NO: 35722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcgaatttttcaggaagtcttttgtcttg

SEQ ID NO: 35723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcgaccatctccctcgttcgagtcctgtc

SEQ ID NO: 35724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcgaggataggaatatcatagggttgtac

SEQ ID NO: 35725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcgagggcgtgagtccgtgaggccttgtt

SEQ ID NO: 35726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcgcactactaacagcacccgcagaggta

SEQ ID NO: 35727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcggaagcatgcacaaagggtgacggccc

SEQ ID NO: 35728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcggaatcctctggctggcgcttgctgcg

SEQ ID NO: 35729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcgggaaagcgcggcttcgaataaggtcg

SEQ ID NO: 35730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcgggagcatgagagatcgcgggatgcat

SEQ ID NO: 35731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcgtacagaagatctaatattgcgttttc

SEQ ID NO: 35732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcgtctgtggcttgctcctgcttggttgt

SEQ ID NO: 35733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcgtgagaaaaggattgcaaagggcattt

SEQ ID NO: 35734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcgtgtacgtccactatcgtgtggttaat

SEQ ID NO: 35735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgctatacgaattatacgagcgccttataa

SEQ ID NO: 35736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgctatgcaatggccgtggccccagcacac

SEQ ID NO: 35737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgctccgatggtgggctagaacgttattcg

SEQ ID NO: 35738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgctcgagtcaacgtcgtgagggttactcc

SEQ ID NO: 35739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgctgatcgcgacaaaacgatgtactggtt

SEQ ID NO: 35740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgctggacttccctgggcgtgtttgcacat

SEQ ID NO: 35741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgctgtagcttgcttaaccttcggttaccg

SEQ ID NO: 35742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcttccgttgtggtttgattttgcactgc

SEQ ID NO: 35743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcttctagcacccgttaacgagaacgctg

SEQ ID NO: 35744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgcttctcggtggatagtaggaggcgtgag

SEQ ID NO: 35745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgctttacctcatgctcgacttgttggcct

SEQ ID NO: 35746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggaacaacgtataaggatcctcggtccga

SEQ ID NO: 35747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggaacaccagaccgggggatgcgtccaga

SEQ ID NO: 35748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggaagcgcgcatcgagaatcgctaaggtg

SEQ ID NO: 35749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggaagggtggcaatagacctcatgttcgg

SEQ ID NO: 35750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggaatatgactctcatgcgctgtttagct

SEQ ID NO: 35751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggacagagcacgggtaagcaacgcgggga

SEQ ID NO: 35752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggacagtgtaaaacgcatggggcgaatcg

SEQ ID NO: 35753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggacatggggcgccactgatgagtccagt

SEQ ID NO: 35754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggaccacaggatgctggtataggtcgggc

SEQ ID NO: 35755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggacgctgtcgagctgatccctcccagga

SEQ ID NO: 35756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggagaccctgaagaactgtgtttccgcat

SEQ ID NO: 35757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggagaggtattgttcgcttcggtttcgca

SEQ ID NO: 35758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggaggtgggtagattatgtgccggtccgc

SEQ ID NO: 35759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggatatgatggtctgctttagccattact

SEQ ID NO: 35760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggatcctcaagaaccggacattgttctct

SEQ ID NO: 35761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggatcgccagtatctcctggtcagctacg

SEQ ID NO: 35762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggatcgcgggggtccggaggtctggtggc

SEQ ID NO: 35763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggatcttttcatgcagcgacaatgtgccg

SEQ ID NO: 35764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggatggctgttttgatgtctcataaccca

SEQ ID NO: 35765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcaacagtgtggatcgaattgggtagct

SEQ ID NO: 35766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcaacatcccggagctcaagtatccgtc

SEQ ID NO: 35767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcaacgtttactgtgtagtcttgggggt

SEQ ID NO: 35768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcaagcaacctcagtctggtccggcgtt

SEQ ID NO: 35769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcaattaggataaacagccagaatgcct

SEQ ID NO: 35770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcacagttagtgcgaaggtgtcccccgg

SEQ ID NO: 35771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcacctgctatagtctgtgatggaccac

SEQ ID NO: 35772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcacggatagcagccgcggtacgaggtt

SEQ ID NO: 35773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcacttttttatgacccacggtatttga

SEQ ID NO: 35774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcagcttggctagtggtgttgcgcgacc

SEQ ID NO: 35775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcatctctactcacggaagccagggatc

SEQ ID NO: 35776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcatgtgtatagcatcgggttgcgaggc

SEQ ID NO: 35777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcccaagcggcaacgtcccactagatca

SEQ ID NO: 35778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggccccaaggttcctcgatactcccggac

SEQ ID NO: 35779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcccgagcagcagtgagcgtgatcgccg

SEQ ID NO: 35780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggccggcagcaggttaggtctgacaggtg

SEQ ID NO: 35781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcctggtctggaacacccatctgtaacg

SEQ ID NO: 35782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcgaggtggatctgggcgcgttaggtcg

SEQ ID NO: 35783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcgattctgggtgagaccgtctgcgtgt

SEQ ID NO: 35784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcgcataggttagggtatcacttgcctg

SEQ ID NO: 35785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcgcggtattgttacggtcctgtgcgcg

SEQ ID NO: 35786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcggcacttgggatctgtttatcgcttt

SEQ ID NO: 35787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcgggcaatacgcagtctgctttgtgac

SEQ ID NO: 35788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcgttccgacagctaaatacgggtggct

SEQ ID NO: 35789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggctaggttacattcgctgaaagacatgc

SEQ ID NO: 35790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggctcacgcgacttgtgtttgactgtgtg

SEQ ID NO: 35791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggctggcttcgtaagggggagcctgggag

SEQ ID NO: 35792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggctgtggatctttatttcattggtaccc

SEQ ID NO: 35793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggctgtgggaacgatgcagtgcttgctat

SEQ ID NO: 35794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggcttcctcgcagcggtcatcgtagttcc

SEQ ID NO: 35795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggctttccgtttgccggcgtagactataa

SEQ ID NO: 35796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggctttcggacggtgcgtaccttgcattc

SEQ ID NO: 35797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgggaccgcgggcgatgttggtggattcaa

SEQ ID NO: 35798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgggagaacgtagacggttgtagaggttcg

SEQ ID NO: 35799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgggagattagtgacccgaattggcgcgac

SEQ ID NO: 35800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgggattggaaatcttttgaccccgttaag

SEQ ID NO: 35801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgggcacctgaacctcacatcagtcacgtc

SEQ ID NO: 35802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgggcactcgcgtatcatgcacattccggg

SEQ ID NO: 35803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgggccgccataaagatgaccagggtatgc

SEQ ID NO: 35804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgggcgcctgtctttgggagggacctacct

SEQ ID NO: 35805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgggcgcgctaaaggtggctttgtttgacc

SEQ ID NO: 35806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgggcgtaccacagcttcccgtgtcaggtg

SEQ ID NO: 35807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgggcgtccggtatgtttggctcattcttg

SEQ ID NO: 35808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgggcgttggcttggctcccagtctaaata

SEQ ID NO: 35809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgggctctctgtcgcgctcgctccgtttgg

SEQ ID NO: 35810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggggaggaggcggcagggctcgtcgaatt

SEQ ID NO: 35811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggggagggattttttgcatttatcacgtc

SEQ ID NO: 35812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggggaggttccagcttccgatcattgggg

SEQ ID NO: 35813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggggtagtaaactttttttatttatcgcg

SEQ ID NO: 35814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggggttagagttattgcccggtgactcct

SEQ ID NO: 35815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgggtacactgttgattcctctgtgatacg

SEQ ID NO: 35816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgggtagcggttagcgctgttgtatagggc

SEQ ID NO: 35817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgggtcgacaatttctgtgccgtaaaaccg

SEQ ID NO: 35818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgggtggacattggcatgggtaagagtagg

SEQ ID NO: 35819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtaaactcgggtcgtctgcgaaactggt

SEQ ID NO: 35820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtaacgtgcgcctactcggttcccgccc

SEQ ID NO: 35821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtaagaacacatgccgttcatgggtgta

SEQ ID NO: 35822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtaggttgttaggcatccaccgaacagg

SEQ ID NO: 35823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtatgttgaagtaagacattggtgttag

SEQ ID NO: 35824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtcccaatacggtcgcggaaggcctgac

SEQ ID NO: 35825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtcctctgtcgccccagtgttatctatc

SEQ ID NO: 35826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtcgctcttgggatttgcatgaatgtgt

SEQ ID NO: 35827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtcggtctcacatgaagccgcggtccgg

SEQ ID NO: 35828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtctgggtcgggtcgggtgctggaacga

SEQ ID NO: 35829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtgatggtgacaggataccacaagtgga

SEQ ID NO: 35830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtgcagtgcgtggtcttcccctccaaga

SEQ ID NO: 35831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtgcgccggtaccacttcccacctccta

SEQ ID NO: 35832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtggcgcactgggatcattcctcgacat

SEQ ID NO: 35833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtgggtggtggctgggtcctgcttgctc

SEQ ID NO: 35834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtggtctgaggtttagttaacgctccct

SEQ ID NO: 35835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtgtatgcgagcctgagtccattacggg

SEQ ID NO: 35836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtgtcgtaccctttgagttctaccagaa

SEQ ID NO: 35837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtgtggcagcaattaaaatcgcgcgaat

SEQ ID NO: 35838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggttaactatacttttcgttatttcgatt

SEQ ID NO: 35839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggttcccgcgcattggtgcattgcagtga

SEQ ID NO: 35840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggttctttttactgttctgccatacttgg

SEQ ID NO: 35841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggttgctggtgatgcttctagtgccgtgc

SEQ ID NO: 35842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggttggtgacgcgaagtgtctcacccacg

SEQ ID NO: 35843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttggtttgtctcattgttacatctcgcatcg

SEQ ID NO: 35844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtaaagtacgcagttagtgagaagaattg

SEQ ID NO: 35845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtaaatgggcaacctcactgcactctcaa

SEQ ID NO: 35846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtaatcacctatcccgtgttgggtaatga

SEQ ID NO: 35847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtaccatatgtatcattctttagcgggat

SEQ ID NO: 35848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtacgattggataacgccttcttcacgcc

SEQ ID NO: 35849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtaggtcaaagaaccgacttgtgttgagc

SEQ ID NO: 35850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtatcactttactggacgccttcttcccg

SEQ ID NO: 35851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtatcgaccaaaacgtgtcaggtccagcg

SEQ ID NO: 35852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtatcgcacgcgcttagctattgcaaaag

SEQ ID NO: 35853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtatctagttagttcgaggcatggatgcg

SEQ ID NO: 35854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtatgttaggtctagacagtaaatgcgta

SEQ ID NO: 35855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtattttagttgtagcgcgtggacaccgt

SEQ ID NO: 35856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtcacacatatcgcgcatgggggggcgtg

SEQ ID NO: 35857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtcattgggctatggggcacggatcttgg

SEQ ID NO: 35858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtccgagtccgcatgttacttcgctatta

SEQ ID NO: 35859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtccgcacggtgaatctgggttaatttat

SEQ ID NO: 35860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtccgtacccgttaggtctcccacgcctc

SEQ ID NO: 35861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtcctcacgcttcattcgttcaatgtccg

SEQ ID NO: 35862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtcgcgtttaccagcagtgttgctagccc

SEQ ID NO: 35863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtctaacatcggttgtttgccaacttgct

SEQ ID NO: 35864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtctaagaatttcacgtttatcctcggtt

SEQ ID NO: 35865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtctaggtcctggaaaaagtgtagtagtg

SEQ ID NO: 35866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtctcttttggaagtccggtaccaattgt

SEQ ID NO: 35867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtctgtatggagagcttaactgtgacccg

SEQ ID NO: 35868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtcttggcgatggacgtgggggtgggggt

SEQ ID NO: 35869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtgaaggaatgtgttgttcaagcggatgt

SEQ ID NO: 35870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtgacacccgcaccgtactccataatggc

SEQ ID NO: 35871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtgcactcgcttacccatctccccagggc

SEQ ID NO: 35872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtgcggataacccatcgttggatcagaag

SEQ ID NO: 35873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtgctcccgatcaatcacaggttaacatt

SEQ ID NO: 35874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtgctgcaacaacctcgtacgatcgcgcg

SEQ ID NO: 35875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtggaaaatgcataattataactttttgt

SEQ ID NO: 35876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtggacgacggacatgtgtttggcggcaa

SEQ ID NO: 35877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtggatatagcagtgtcgccgtgtcgttg

SEQ ID NO: 35878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtggatgttgctctattgcaattcggtgg

SEQ ID NO: 35879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtggcgacgtagtacatactctcatgcct

SEQ ID NO: 35880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtggctctttcccgaggcggcatctaagg

SEQ ID NO: 35881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtgggtgatttaaaactcgtttattggtc

SEQ ID NO: 35882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtggtcgggtgttgtgctgttcctcttgc

SEQ ID NO: 35883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtggttactctgtctgttggtaattatcc

SEQ ID NO: 35884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtgtagcctgtgggtacgtccttagtgca

SEQ ID NO: 35885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtgtcagtcacaacgcgtactggggtatt

SEQ ID NO: 35886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtgtccaaccggagcatgagtcagtaagc

SEQ ID NO: 35887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtgtctgttctcgctgtttcgttactgga

SEQ ID NO: 35888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtgtgcgggcaatggaactagggtccgaa

SEQ ID NO: 35889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtgttactaggcaacattttatgagcgct

SEQ ID NO: 35890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtgttggtagcgagtgacgttttgttctg

SEQ ID NO: 35891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgttaaatcaggttttccaggggggacggg

SEQ ID NO: 35892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgttaactaattcgccggccgtatacgtct

SEQ ID NO: 35893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgttaactacggccaaactccgcggctggg

SEQ ID NO: 35894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgttaagcgttcggtcatggacgacgggtc

SEQ ID NO: 35895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgttaccctccactagtccaggcagatggg

SEQ ID NO: 35896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgttaggctgattttatgcgttaagtgcgg

SEQ ID NO: 35897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgttattccactatatacttgcctagttgc

SEQ ID NO: 35898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgttccttcttagtcgctctggagagttcg

SEQ ID NO: 35899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgttctctcggtttggcggttacccttaat

SEQ ID NO: 35900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgttctgtagttccggttaacgacgcggag

SEQ ID NO: 35901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgttgcgattcatttgtttgacttcatctt

SEQ ID NO: 35902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgttgcggcgctccctcagcatagggtcgt

SEQ ID NO: 35903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgttggcttctaggggcagtcatgcggagg

SEQ ID NO: 35904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgttgtcacgctccgatcggttatccggga

SEQ ID NO: 35905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgttgtcgtgcggctagagcttgggggaca

SEQ ID NO: 35906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgttgtgtagtattgtaacacaggcggaag

SEQ ID NO: 35907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtttacgaaccggaacaacatagtgcacg

SEQ ID NO: 35908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtttacggtactttcggggcgcgccgtct

SEQ ID NO: 35909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtttcaaacagctgcaactaaaggacgtg

SEQ ID NO: 35910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtttctcacatttatcaggaaaatgttca

SEQ ID NO: 35911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtttgcaccggcatgcatgatctaaccgc

SEQ ID NO: 35912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtttgctgtaaaatgtgcgcaaaatcgag

SEQ ID NO: 35913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgtttgtgtccaataactctgcgtttaaag

SEQ ID NO: 35914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgttttcacctgtgcgcggggggcattaag

SEQ ID NO: 35915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttgttttggttaactctagtgccagtccgtg

SEQ ID NO: 35916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttaaaaaggctccaggacgcggggaccttc

SEQ ID NO: 35917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttaaataatagtctgtttgttctgtgattc

SEQ ID NO: 35918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttaaatacttaagagaggtcggtctactca

SEQ ID NO: 35919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttaaatacttttaggtccacgatcgggatc

SEQ ID NO: 35920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttaaccctgtgcggcgatggtaaactgagt

SEQ ID NO: 35921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttaacgatcccccaacagttcctgaaccgt

SEQ ID NO: 35922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttaagatgcattgcgtggctcgatctgcgt

SEQ ID NO: 35923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttaagggtgatgatggccttaagttcgggc

SEQ ID NO: 35924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttaagtagggacggctcggcgtcttaggac

SEQ ID NO: 35925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttaataaattggatagtcccgccgaacaag

SEQ ID NO: 35926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttaatgatatcccagaatgcatggcacaag

SEQ ID NO: 35927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttaattgacttagggctatcgctaatgctg

SEQ ID NO: 35928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttaatttacttaattgattaacatccatgc

SEQ ID NO: 35929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttacaacagtgcgcgtgccacacaggccgg

SEQ ID NO: 35930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttacaagggtcacagctcccgaatcaagac

SEQ ID NO: 35931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttacacaccctcctggatccatgggctgtt

SEQ ID NO: 35932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttacactggttgacgattttctttcacccc

SEQ ID NO: 35933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttaccagctgtttaggcaaggcaattcagg

SEQ ID NO: 35934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttacctctaagcttcaggcttctggcggtg

SEQ ID NO: 35935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttacctttgcattgaccatcggccattagg

SEQ ID NO: 35936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttacgatacagcctctaggttgatcagttc

SEQ ID NO: 35937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttacggtttcccatcgcccggctatccgtt

SEQ ID NO: 35938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttacgtatcgggaccgcctacctcttgcgg

SEQ ID NO: 35939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttactattctctggtgtacgacgagctacg

SEQ ID NO: 35940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttactcgtacacggaacggaacatgttatt

SEQ ID NO: 35941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttactgagtaagaggaattggcatccgcga

SEQ ID NO: 35942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttactggcaagcacatgcaaccgggggttg

SEQ ID NO: 35943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttactgtgttttgtacgagttgcttgcagc

SEQ ID NO: 35944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttacttgcctgatatttattcgtgagcacg

SEQ ID NO: 35945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttagatacatagctcttcgacgtgattgca

SEQ ID NO: 35946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttagatgcgggctgattggcggcgtttagc

SEQ ID NO: 35947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttagatgtgcaaggaacagtatcagtttgt

SEQ ID NO: 35948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttagcgctaaaacgttgcgacgcggagtgg

SEQ ID NO: 35949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttaggacatgaatgtgtgtacctttatcga

SEQ ID NO: 35950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttaggtagacgtgcgtgatagtttctgcgc

SEQ ID NO: 35951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttagtaatgcataaggtccattatgtgcaa

SEQ ID NO: 35952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttagtattgggtcgctcagtcggcacagga

SEQ ID NO: 35953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttagtcagcattctcattcggtactttcgc

SEQ ID NO: 35954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttagttcaccttggatggctcaggctaatt

SEQ ID NO: 35955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttagtttagttagtctcgatggggttaagt

SEQ ID NO: 35956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttataatcatgggaaccgctgttttggttc

SEQ ID NO: 35957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttataatcttctcgggccattccagtcacg

SEQ ID NO: 35958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttataccacggtaatgatcggatttccttg

SEQ ID NO: 35959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttataggcgatgcctgcagtttgattaggg

SEQ ID NO: 35960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttatcccttttacagtttcctagctgcccc

SEQ ID NO: 35961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttatcgacgggccgttgagccaccgccttt

SEQ ID NO: 35962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttatgtagcgcggatttcaacggccgacta

SEQ ID NO: 35963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttattcgtgcactagggggagcgggtcatc

SEQ ID NO: 35964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttatttaatacaagtctcctgatgtgatta

SEQ ID NO: 35965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttatttcgatgaaccataccctcatcgtca

SEQ ID NO: 35966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcaatcgggccgccccgatagtgcagatg

SEQ ID NO: 35967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcaatgagaacgtcgtatgcgcgggtctg

SEQ ID NO: 35968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcacaatgtagaactaatgggggctaagg

SEQ ID NO: 35969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcacacccgtaggcttgtttgttctgctg

SEQ ID NO: 35970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcacgcgttagagtcgattgaatagctcc

SEQ ID NO: 35971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcacgtgatgtctctgaaacttacgaagt

SEQ ID NO: 35972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcagggtgagggatattgcgtgtgagctg

SEQ ID NO: 35973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcataatgtccggactgaccggttcgcgt

SEQ ID NO: 35974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcatccgccggacgttttaatctccactg

SEQ ID NO: 35975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcatgagactggcgttggggatggcgggt

SEQ ID NO: 35976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcatgtcgtcggcagtctgatacccagcg

SEQ ID NO: 35977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttccaaccgtaagcatgacccatgtcatat

SEQ ID NO: 35978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttccaacggtctcgttcgcgcttcatcgag

SEQ ID NO: 35979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttccactcaccgcgtgcgttcaagggcatc

SEQ ID NO: 35980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttccagtcagtctggtaattcgagggtcgg

SEQ ID NO: 35981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttccattctacggggctcaaatatgtggct

SEQ ID NO: 35982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcccgaactttttgactcatgggcactga

SEQ ID NO: 35983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcccggtttgctacggtctaccttctggt

SEQ ID NO: 35984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttccctggactgtactatatgcattcacac

SEQ ID NO: 35985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttccgcatctttcgctaaccctggactgcg

SEQ ID NO: 35986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttccggatgtcgattccgcgtgctgaccgt

SEQ ID NO: 35987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttccgtgaatagcggtgatcgatttctgat

SEQ ID NO: 35988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcctacgcgcctttgtaatgtggcggacc

SEQ ID NO: 35989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcctcattgccctttagtccgtcaatgtg

SEQ ID NO: 35990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttccttagcgttcgaggtttatcttcctca

SEQ ID NO: 35991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttccttgcttactcgttctcgacacagagc

SEQ ID NO: 35992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcgaagcaggtcctcagggagtactcgcg

SEQ ID NO: 35993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcgaataatccttcgccttccctaaccat

SEQ ID NO: 35994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcgagaagtggtaccgcgggccgctattg

SEQ ID NO: 35995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcgatctcggtgcagagaccccagttgcg

SEQ ID NO: 35996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcgcacgtgcgcgcatctgcatatcccta

SEQ ID NO: 35997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcgcagcactcaccggtcggctgttagga

SEQ ID NO: 35998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcggcaaaagatgagttacaaacgcctaa

SEQ ID NO: 35999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcggctcattacgtaagacatacagcctg

SEQ ID NO: 36000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcgggccctgtcgctatggcgcgcgatcc

SEQ ID NO: 36001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcggggtgttgggcgtgttccgtgtaggt

SEQ ID NO: 36002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcgggttacgagtgacagccctccgtgcg

SEQ ID NO: 36003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcgtgattgaggtgtcctctcctaatctg

SEQ ID NO: 36004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttctattgcggcatccacaccttggggtgt

SEQ ID NO: 36005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttctcaggactcatctttgttccggtcacg

SEQ ID NO: 36006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttctccgacttgacattatatggtttccga

SEQ ID NO: 36007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttctcgaagattgcacactaatgtttgcat

SEQ ID NO: 36008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttctgagcgaatatccacgatctctctgaa

SEQ ID NO: 36009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcttctcgcttgaccgaggtaggttgggt

SEQ ID NO: 36010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttctttattgtatcatgagtggcgcgtatg

SEQ ID NO: 36011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcttttgtgatcacagttgcttggttttg

SEQ ID NO: 36012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttcttttgttggatcagatgttcagttagt

SEQ ID NO: 36013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgaagagacagggtgggccttacatttta

SEQ ID NO: 36014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgaatacgaacgacctaaaattccaccac

SEQ ID NO: 36015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgacatgggtgggtgttgagtgcgctaac

SEQ ID NO: 36016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgacattaagaaagccacactgttgggca

SEQ ID NO: 36017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgacggggtcttgacatgtacttctgtct

SEQ ID NO: 36018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgagattccggaaatgcagatgtgcgccg

SEQ ID NO: 36019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgagcagatgaaaaacttttctcgtacgt

SEQ ID NO: 36020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgagctctccggctgtacactgtttctgt

SEQ ID NO: 36021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgagttcgagttccgtcacggtctcgcaa

SEQ ID NO: 36022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgatccctcgcccttccagtcccgatgga

SEQ ID NO: 36023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgatcgtacatttgttgtttacaatgcat

SEQ ID NO: 36024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgcaaccaatttgctacgcgatgcaccgg

SEQ ID NO: 36025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgcaccgaggggcccgctgatgtttgatc

SEQ ID NO: 36026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgcagacagtggatggacaaaccgcttga

SEQ ID NO: 36027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgcagctaagtgtggcttattgttatggg

SEQ ID NO: 36028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgcgagctaacacatgaagctcgatgacg

SEQ ID NO: 36029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgcgaggaggcgcaacgcgattcgaactg

SEQ ID NO: 36030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgcgcactgcttgggatacagctctttgc

SEQ ID NO: 36031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgcggggggcttggagacaaggtgcttca

SEQ ID NO: 36032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgctcattatctgctcatcaagcgcctgc

SEQ ID NO: 36033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttggaaacgggacaacgtcttcgaggcagg

SEQ ID NO: 36034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttggacgcggttgtgggatgaatggctcac

SEQ ID NO: 36035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttggacgctcactgtccaacatccgccggg

SEQ ID NO: 36036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttggcagtcgcgctccagtacgtcgatgtt

SEQ ID NO: 36037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttggcatgcacttgtggtgggcgaaggggt

SEQ ID NO: 36038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttggccaaaggacttacggaacgactacgt

SEQ ID NO: 36039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttggccagtgtttccaagcttccaaaggga

SEQ ID NO: 36040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttggcctctgtcatattgaagatctgcttc

SEQ ID NO: 36041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttggcggtcagtccatcagtcaacctgtga

SEQ ID NO: 36042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttggctggtctgcggctagtacataagggg

SEQ ID NO: 36043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgggaattatgtgtttaacaggtgtagtg

SEQ ID NO: 36044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgggcaattccatatcatcattccagcct

SEQ ID NO: 36045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttggggacatcggcgaacggtcaccggcta

SEQ ID NO: 36046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgggtaggtcttctcccttttcgtgtcac

SEQ ID NO: 36047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgggtcgtccctttttggtcagcctcggt

SEQ ID NO: 36048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttggtgcgggcgttaaacttacctatggct

SEQ ID NO: 36049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttggtgctcctttgggaagaaccgctcggt

SEQ ID NO: 36050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttggtgttatttagagggattgcaggatca

SEQ ID NO: 36051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttggtttggacatcagatgtatatggtgtc

SEQ ID NO: 36052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgtacatccgcggcagtttcatggcgcta

SEQ ID NO: 36053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgtacctagtgggaactgttgcgtcatca

SEQ ID NO: 36054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgtcacttatatagcctgatcttctcgtc

SEQ ID NO: 36055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgtccagacagaggggctgggctctgcgc

SEQ ID NO: 36056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgtccctgctgcttacgtcgtcttaagct

SEQ ID NO: 36057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgtccgacaactatggtaggctccacagc

SEQ ID NO: 36058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgtctaagtcacggcagagtcaatttccg

SEQ ID NO: 36059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgtggctatcatgatgtgtctgcagcctc

SEQ ID NO: 36060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgtgggcagccaggtctcgggtcccattt

SEQ ID NO: 36061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgtgtaccctgctcctgtaatcgcaggca

SEQ ID NO: 36062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgtgtgggctgaaaacctgcttaaaagta

SEQ ID NO: 36063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgtgtgtcagtcaaactattactcttagc

SEQ ID NO: 36064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgttcctgggcttgaagtataagctgttt

SEQ ID NO: 36065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgttcgcacatcctccgccaggggtccgc

SEQ ID NO: 36066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttgttttggtggtgtctagctctgatgtcc

SEQ ID NO: 36067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttaaaggggaatctaactatataatctgt

SEQ ID NO: 36068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttaagcatttaggcacttaatttgttcgg

SEQ ID NO: 36069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttacatccaagtactgtctgcatactgcg

SEQ ID NO: 36070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttacatcttcttcgcttacgtctgcattt

SEQ ID NO: 36071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttacgaccggctgcggaagggtgaccatt

SEQ ID NO: 36072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttacgagggcggtactgaacacttggctc

SEQ ID NO: 36073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttactaacctcctgcagtttatgttcaga

SEQ ID NO: 36074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttagggtgttgtggatgacgttagtgact

SEQ ID NO: 36075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttataatacatttacacgtaatcctttgg

SEQ ID NO: 36076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttatcatgtgcccactcagttaccggcca

SEQ ID NO: 36077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttattttcggccaaccaagttccctgtat

SEQ ID NO: 36078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttcactttacgctcaactatcgtttcacc

SEQ ID NO: 36079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttcaggtgcctgaggttgcacggtgtagg

SEQ ID NO: 36080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttcattcgccagtatgccgggttgggatt

SEQ ID NO: 36081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttccatttgtttcgagcgtccaagccact

SEQ ID NO: 36082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttccgcatgcatgcactctaacttgcgtg

SEQ ID NO: 36083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttcgcaaaccaaccaagctgtccgggttt

SEQ ID NO: 36084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttcgggcgttctgtgagcttgggtagtga

SEQ ID NO: 36085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttcgtttgagcggtggtgggcggtggtgt

SEQ ID NO: 36086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttctcagtacactcttcaagcggcgagtt

SEQ ID NO: 36087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttctccggtggatgtacttatccctttcc

SEQ ID NO: 36088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttctcggatctattgtatatttggtaatt

SEQ ID NO: 36089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttcttgttcgcctgacgcgtcagtggtaa

SEQ ID NO: 36090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttgaagaatagcgagctgtcatctcacct

SEQ ID NO: 36091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttgacccgggtccattcttccctgatcgt

SEQ ID NO: 36092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttgcaaccctgttcgtgtttgttagggcg

SEQ ID NO: 36093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttgcaactttcacataaggcacactcacg

SEQ ID NO: 36094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttgcgggaaccggtatcggacacattgct

SEQ ID NO: 36095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttggatatccttctgtcgtattcgcgtct

SEQ ID NO: 36096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttggcgtacacgagtgaagatcaggcaac

SEQ ID NO: 36097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttgggtaaacgtcggttgagatctgcgct

SEQ ID NO: 36098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttggtatcacggaatccttcgggcgctta

SEQ ID NO: 36099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttgtaatctgcgctatagttcacagattt

SEQ ID NO: 36100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttgtcccacatagattctacacgccgtgt

SEQ ID NO: 36101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttgtccgctctgggcgctattcgagggac

SEQ ID NO: 36102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttgtcggcggaccctaatgcatggctctc

SEQ ID NO: 36103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttgtgttgattacttactttcagctgcgc

SEQ ID NO: 36104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttgttatcaggataatgataggtagcgga

SEQ ID NO: 36105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttgtttttctatagcggctatggcttaga

SEQ ID NO: 36106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttttattgaagcgtgtcacaatttccccgt

SEQ ID NO: 36107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ctttttcccgtcatggtagctctctcccgaac

SEQ ID NO: 36108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttttggtaaagcatgtagggcagtctccc

SEQ ID NO: 36109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
cttttttgtgcgagcaatatcttggtgcccgc

SEQ ID NO: 36110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaaaaagagcttgagctttttcaccttgtg

SEQ ID NO: 36111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaaaaggcgatggtcattatgggctagtta

SEQ ID NO: 36112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaaaccttgaaaggcaagtgcgtgtgcgtg

SEQ ID NO: 36113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaaagatggaaatttttaggtcaaaggtta

SEQ ID NO: 36114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaaagctgacatggccggctcccgcgaatc

SEQ ID NO: 36115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaaaggtacaggtggaccttccgggtgcgg

SEQ ID NO: 36116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaaagtcaatacgtacgtacgctggatccc

SEQ ID NO: 36117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaaattagggctaaggccgcacattcgtgc

SEQ ID NO: 36118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaacaggcatgaccttcctgggcgtttaag

SEQ ID NO: 36119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaacatgtagaagtgattcgcgccatcgga

SEQ ID NO: 36120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaacccacgagtgcaaggatcttccagtca

SEQ ID NO: 36121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaaccgaggggaagaaaagaattgagggcc

SEQ ID NO: 36122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaacctcgtgtgaagaacttgcgccgcaac

SEQ ID NO: 36123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaacctgtaacgtcctgctggacacaacaa

SEQ ID NO: 36124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaacgagggcggcatgcgtcaatccacgct

SEQ ID NO: 36125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaacgcgattcgtaacatcctagtcgctct

SEQ ID NO: 36126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaacgtgcgactccataggccgaacatggt

SEQ ID NO: 36127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaactagcagagaggtagattaagacaact

SEQ ID NO: 36128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaactagtttgaaacagtttggagtaaccg

SEQ ID NO: 36129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaactgttaaggcaaccgcaatgctgttag

SEQ ID NO: 36130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaagatggccctcggtggcttgctggggcg

SEQ ID NO: 36131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaagcactgacgcctttttggcatgatgtt

SEQ ID NO: 36132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaagcgaaactcacgcgtatgcattgcgca

SEQ ID NO: 36133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaagcggcctctgacctcgttgttagctgc

SEQ ID NO: 36134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaagctgtagaaacaagtgtcgggtcatcg

SEQ ID NO: 36135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaagtggaggcgtactgtacgtgcgctcgg

SEQ ID NO: 36136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaagttgtatgtgaacccagatgtttgttc

SEQ ID NO: 36137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaatgcggagcttgtccatggtaccgacgt

SEQ ID NO: 36138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaatgtttcagcttttaaggtacaaaggcc

SEQ ID NO: 36139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacaaagcgtcacgtttggtaccgtgttta

SEQ ID NO: 36140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacacaacgcatatcaaaagttacaagcgg

SEQ ID NO: 36141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacacaaggtctagtaggatccctttgggc

SEQ ID NO: 36142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacaccagtacgctctgaatcagtcggaag

SEQ ID NO: 36143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacacgaatcatactaacagtcactcaggt

SEQ ID NO: 36144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacacgattccactttcggagcgttgaggc

SEQ ID NO: 36145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacacggacctcggcggtgagggcgtctcc

SEQ ID NO: 36146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacacggcgcctatatcagcccttcataat

SEQ ID NO: 36147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacactacggagaacgaggacactgcgtca

SEQ ID NO: 36148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacagacacatgattgaacgcgcatggtcg

SEQ ID NO: 36149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacagagacgaccaactaaacggtctggcg

SEQ ID NO: 36150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacagcgccgtccgcttaattaggcaaccg

SEQ ID NO: 36151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacagtatcccaacaattcatccgggaacg

SEQ ID NO: 36152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacagtccgcccggtactcgcgccccttat

SEQ ID NO: 36153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacagtctggagtagggcacagtcgttatg

SEQ ID NO: 36154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacatggcgtaacccgctttcaagcaagtc

SEQ ID NO: 36155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacattctactaacgctggtgcgaccgaag

SEQ ID NO: 36156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaccaagcatatcgttcgtcaaactacccg

SEQ ID NO: 36157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaccacaggcaatgcgttcattctaatgat

SEQ ID NO: 36158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaccataagtttggcatggctccatagcgc

SEQ ID NO: 36159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaccccgccgactctttagttgttatattt

SEQ ID NO: 36160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacccgttgtacagagactcgcggaccagt

SEQ ID NO: 36161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaccgaaacggatcccgtggtgcctactta

SEQ ID NO: 36162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaccgccgaatgcccattcgaatgggatgc

SEQ ID NO: 36163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaccgcggggtgctccggcctgggtgcctc

SEQ ID NO: 36164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaccgcgtccacgaaccgctcgggccccca

SEQ ID NO: 36165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaccgtctgtctggggcgcgtccgtgctcg

SEQ ID NO: 36166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacctggtagacctgcagggtaacgacgcg

SEQ ID NO: 36167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaccttgatctgcgtgcccacagtaaaaga

SEQ ID NO: 36168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacgaatggccctctttctggttctgggcg

SEQ ID NO: 36169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacgattctctctatgggtgctagtgatag

SEQ ID NO: 36170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacgcggaacctcaggtagaacattgatcg

SEQ ID NO: 36171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacggctagtctcgtcacgcggaagttccc

SEQ ID NO: 36172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacggggcagtgtcgtgatgccggtcattc

SEQ ID NO: 36173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacgggggaccgacgtacccaatcctaccc

SEQ ID NO: 36174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacggggtaacggagaaggtctcgcccacg

SEQ ID NO: 36175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacgggtgcgatctggtggggttgtagata

SEQ ID NO: 36176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacggtgttttggaaggataatgcccacgt

SEQ ID NO: 36177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacggtttctctccgggtcatctcacttcc

SEQ ID NO: 36178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacgtagaactgaatagaactttcgttgcc

SEQ ID NO: 36179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacgttacgccgaaaatggatcatggcgga

SEQ ID NO: 36180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacgttcacgcttagcatgtgttttccctg

SEQ ID NO: 36181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacgttggttgcctaaacctaaatcctccc

SEQ ID NO: 36182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaactactcggcttcagtaccccggtgtagt

SEQ ID NO: 36183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaactatttcgattattgtttttcgtgagga

SEQ ID NO: 36184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaactcagttcttcttcacctggacattgtg

SEQ ID NO: 36185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaactctgagatatcacgttaaacatgaaat

SEQ ID NO: 36186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaactgcatctcgaggagtgttgcggggtct

SEQ ID NO: 36187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaactgtcggtgaactgctcgcgtcttcgga

SEQ ID NO: 36188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaactgtggcggcgaggcgaaaagtatggcg

SEQ ID NO: 36189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacttgcacaaaggtgtcgggtctggacga

SEQ ID NO: 36190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaacttggatgctagaatactgaacgcgtac

SEQ ID NO: 36191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaactttattgagtaaggcgcttggctgaat

SEQ ID NO: 36192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagaagcgtccataacatgtaccattctga

SEQ ID NO: 36193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagacaaaaattccaagccaaagaatgggt

SEQ ID NO: 36194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagacaatgcatcgggttgctatgtctgat

SEQ ID NO: 36195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagacggcaggacccggagcgcttggattt

SEQ ID NO: 36196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagacggggcggacggtgtagagctgtggg

SEQ ID NO: 36197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagagagcagccctggagcccactaacccc

SEQ ID NO: 36198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagatccgcggctgtcgaggtctttagtgg

SEQ ID NO: 36199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagattaacttaatccgaaaagaaggacga

SEQ ID NO: 36200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagcacggcacagccccccgactcatgcgc

SEQ ID NO: 36201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagccaacaaaagtagtacataagcgcgca

SEQ ID NO: 36202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagcccatctggtcctttaagaacggtgct

SEQ ID NO: 36203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagccgaaagtgaagtgcatgccgaaacta

SEQ ID NO: 36204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagcctacatcagaagtcgctgccatgggg

SEQ ID NO: 36205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagcggtaacttagggagagaaggccgcgt

SEQ ID NO: 36206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagcggtgtataatactccagatctagtgt

SEQ ID NO: 36207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagcgttcaaaggataagagcccggcgtta

SEQ ID NO: 36208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagctgatcgcgccaatgtaaggctgtcgt

SEQ ID NO: 36209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagctttaggcaaatgtcgttgtccgtggt

SEQ ID NO: 36210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaggagaaggggcgttacttctttttttgt

SEQ ID NO: 36211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaggaggtgtgtgcgctattggagagtcgt

SEQ ID NO: 36212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaggagtatttaatcaatttggagagtatt

SEQ ID NO: 36213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaggatgcaagatctccggcgatacctcgt

SEQ ID NO: 36214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaggcaatgcctatagggcgtggacggaag

SEQ ID NO: 36215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaggcatcggggcaggaaccgtggccattc

SEQ ID NO: 36216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaggccccggcaaacgtgtttaacatccgc

SEQ ID NO: 36217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagggattcacaggcgggcgacccatcgga

SEQ ID NO: 36218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagggcattcccgtaacggcgtgtgcggcg

SEQ ID NO: 36219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaggggaccccgttcgacttctgctagatg

SEQ ID NO: 36220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagggggtgttggtccaacctgcagccgtg

SEQ ID NO: 36221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagggtaccggaggggcaccattcgtgcga

SEQ ID NO: 36222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagggtacctctaaaatccttccgtcacaa

SEQ ID NO: 36223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaggtaaatcgatgcgaatggccggaattg

SEQ ID NO: 36224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaggtcagatgtcggaacagtgtcggttgg

SEQ ID NO: 36225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaggtcctctttcattaatacaggcaaatc

SEQ ID NO: 36226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaggttcatgaatttcttgaatctctttta

SEQ ID NO: 36227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaaggttttccccctggcttacccaaaaaca

SEQ ID NO: 36228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagtatagcccacgatgcgcttcagcacca

SEQ ID NO: 36229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagtcagtgccgagcgcagtatggttccct

SEQ ID NO: 36230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagtccctcttcgatatcagcgaaccgtaa

SEQ ID NO: 36231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagtcgttttgttcgacactaaggctgata

SEQ ID NO: 36232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagtctcgtacgggagggtgtctagccagt

SEQ ID NO: 36233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagtgacgatgtatgacgtggacacggaat

SEQ ID NO: 36234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagtggacaaacagatggcttataccctcg

SEQ ID NO: 36235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagtgtcctcaggtctgtgcccaagggtat

SEQ ID NO: 36236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagttcctttgatgcttcttaggtccgact

SEQ ID NO: 36237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagtttaaaactagcgaccatttcctcccg

SEQ ID NO: 36238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaagtttcggggcatcatggcacattcgtag

SEQ ID NO: 36239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaataacttatttcacacttcttcctgcaac

SEQ ID NO: 36240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatacatgattctatgctgggtcaataggg

SEQ ID NO: 36241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatactttatctgttgagccacaaattacc

SEQ ID NO: 36242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaataggtggtacgcaggttatctctaagcg

SEQ ID NO: 36243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatatagaaacaggctcaggttgtttcggc

SEQ ID NO: 36244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatatgtacctgtcggacgcattcttaacc

SEQ ID NO: 36245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatcaaaaagggcattgctatataccgacc

SEQ ID NO: 36246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatcaaccattaaatcaatcgaggatgtcg

SEQ ID NO: 36247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatcagagtagcggtgtgtagaaccctgag

SEQ ID NO: 36248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatcagcggggctagcaggcgcgggctcgt

SEQ ID NO: 36249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatccctgtaatccggaggtcgggaacctc

SEQ ID NO: 36250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatcggaacgggaacgggtgctggacccat

SEQ ID NO: 36251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatctcaaatgctactgcttggttgtgtgc

SEQ ID NO: 36252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatctgttgctgccgcctgttaataaggag

SEQ ID NO: 36253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatcttaccaaggccgcgttagttagttct

SEQ ID NO: 36254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatgatcttctttattatttcacgcctgcc

SEQ ID NO: 36255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatgcaatacgatggtctaacggtgaatcc

SEQ ID NO: 36256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatgcggatctttccgtgctgcagattcca

SEQ ID NO: 36257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatgcgtcgatgcctgtgttgcgttgagga

SEQ ID NO: 36258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatgctcagtatcatctttactcgtccttg

SEQ ID NO: 36259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatgctgccaggtggttttgaactttcgta

SEQ ID NO: 36260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatgctgctcccttgcagacactacccatg

SEQ ID NO: 36261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatgggacaccatgttcgggctacatccta

SEQ ID NO: 36262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatgggcgcgtatggcagtgttttccaccg

SEQ ID NO: 36263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatgggtcactgatggctaggtagcgctgc

SEQ ID NO: 36264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaatgtccgcgatggtgcttgcctctggggg

SEQ ID NO: 36265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaattacgctgacacactgggctcgcatacc

SEQ ID NO: 36266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaattatgcgtggaatgtatcatctcccaga

SEQ ID NO: 36267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaattattctgtcagggacgtagcgtgatga

SEQ ID NO: 36268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaattcgaccgaatgaggaatcaaggctgtg

SEQ ID NO: 36269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaattggggtcactgttggttgtcctgcgag

SEQ ID NO: 36270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaattggtagtgtgcaaggcgttctcacggg

SEQ ID NO: 36271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaaaagagactaatcgacgagccgtgtgg

SEQ ID NO: 36272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaaaccaacgccaagtaaagcgctgaatt

SEQ ID NO: 36273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaaatgtctgaacaatactgccacttggc

SEQ ID NO: 36274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaacagcggattcgattagagtcttgcgt

SEQ ID NO: 36275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaactccgcttccggattgtccgtttgcc

SEQ ID NO: 36276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaagaaagcacgttcctccacgggttagc

SEQ ID NO: 36277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaagactttcggggtcatggtttttctcg

SEQ ID NO: 36278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaagcacggagctgctatgggtgctgctg

SEQ ID NO: 36279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaagccagggagtcttttacggcactagg

SEQ ID NO: 36280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaagcctgtttgtactgatgttcgagggc

SEQ ID NO: 36281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaagctccgtgttgttaggtcagtacttt

SEQ ID NO: 36282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaagctgagcatatagacctttcccagtt

SEQ ID NO: 36283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaaggaaaagtgagtagctcttgttcatt

SEQ ID NO: 36284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaagggatattgcggactaacaatgttcc

SEQ ID NO: 36285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaagttgttgtcaaacccgttgtctttct

SEQ ID NO: 36286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacacaatttacccgtacaaggttcgagaac

SEQ ID NO: 36287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacacacgatgtggggatggttgcatggatg

SEQ ID NO: 36288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacacagcaagcgcccgggtaatgtttagtt

SEQ ID NO: 36289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacacagccattccttgcgcgtataggttgg

SEQ ID NO: 36290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacacagtgttgccttcacgacaggaggtga

SEQ ID NO: 36291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacacatgcgagctccaggggtttggcaaac

SEQ ID NO: 36292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacacccagacgatttggtatgaatagtttc

SEQ ID NO: 36293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaccggaacatacttgtgtacgcacgagc

SEQ ID NO: 36294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacacgccccgataccgcgtacatcagcgtt

SEQ ID NO: 36295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacacggatgagcgatactgacgatagttag

SEQ ID NO: 36296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacacggtaaaagcttaactacccgcccacc

SEQ ID NO: 36297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacacgtgctctcgcggaccggctaccacgc

SEQ ID NO: 36298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacactcccctgaaaggtttcctgtaaggag

SEQ ID NO: 36299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacagacactaatcttgatcttcgatgaggt

SEQ ID NO: 36300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacagacgaacagtacgggaccggagcggac

SEQ ID NO: 36301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacagagagttttgatatggcccgccacact

SEQ ID NO: 36302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacagatgactagaaagctcctccagactag

SEQ ID NO: 36303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacagcactggtcccattccgcttgcttcat

SEQ ID NO: 36304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacagcgggtacactccggtttcgcagggcc

SEQ ID NO: 36305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacagctgccccccgccaagcgtgtccttcc

SEQ ID NO: 36306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaggaggggaccacctgagcacggcatgc

SEQ ID NO: 36307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacagggtgcttctaaaaacctaacgcttag

SEQ ID NO: 36308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaggtacctgccaaattcgactccttatc

SEQ ID NO: 36309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacaggtcccattaacttcttgcatgatggg

SEQ ID NO: 36310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacagtacagcacggcgtaagtgtaaaggcc

SEQ ID NO: 36311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacagtgacgcaggtgggtgaacttaggtgg

SEQ ID NO: 36312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacagtgcttactcgtgtagtcggttcattc

SEQ ID NO: 36313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacagttaggcatgcttcccgtagattcgac

SEQ ID NO: 36314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacatacacgatctcacgtagtgatggcgat

SEQ ID NO: 36315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacataggtgcttccacgagtcggtctggga

SEQ ID NO: 36316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacatccccaaacggaggacgagggcttttt

SEQ ID NO: 36317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacatccgacatgtctgaatgttgtttacaa

SEQ ID NO: 36318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacatgctactggagcgagggtttgcgtaac

SEQ ID NO: 36319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacatgggtccgactcgccataaacagaggt

SEQ ID NO: 36320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacattatcagagcctgctatgcgtgatgta

SEQ ID NO: 36321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacattgggcgtaaaggccgcctatcgtcct

SEQ ID NO: 36322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacatttgatgcagatcccgtctcctgggcc

SEQ ID NO: 36323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacatttgatgggcgtttgtactccgctatg

SEQ ID NO: 36324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccaaaactgatctcgatccttgtgtgtgt

SEQ ID NO: 36325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccaaaggttattggcgattagtgcgtacg

SEQ ID NO: 36326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccaacggcggagacaagtgcattcgaggg

SEQ ID NO: 36327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccaatgcggtagtatgcatccccgctcca

SEQ ID NO: 36328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccacacctctgatgaagatgttgtcgatt

SEQ ID NO: 36329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccacgatcttgcacctcgtccctgtcaag

SEQ ID NO: 36330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccagctgggtcaatacgcagagaacttaa

SEQ ID NO: 36331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccagctgtacggataatggccgctactcg

SEQ ID NO: 36332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccaggcaacttacccacgctgccccttga

SEQ ID NO: 36333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccatacttgcatctcaatgacttttacgt

SEQ ID NO: 36334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacccacatgatggtcggattactaaggtat

SEQ ID NO: 36335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacccaggcctctagcccgaccaatcttccg

SEQ ID NO: 36336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacccagtatcatcgtacatttggttattca

SEQ ID NO: 36337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacccagttttagattaggaacttgcatcct

SEQ ID NO: 36338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacccccctgtgaacactttgccagtgaggt

SEQ ID NO: 36339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacccgcacgcagcgtcgtatgtattcctca

SEQ ID NO: 36340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacccgcagaggcgataggcttctcttatgc

SEQ ID NO: 36341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacccggcaggttaattacaaatttcttgta

SEQ ID NO: 36342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacccgtggcgagctgagcggcctcttcagt

SEQ ID NO: 36343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacccgttgctgttcgacgtgcacgggtttc

SEQ ID NO: 36344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccctatcatgcgtgcttgctctcatcttt

SEQ ID NO: 36345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccctcaccgtatgttatatgcctgctgta

SEQ ID NO: 36346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccctggcagacagcggccattacctccgt

SEQ ID NO: 36347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacccttaactgcgtggggaggtgttgcagg

SEQ ID NO: 36348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacccttttagaagtgagtatcaagcggttc

SEQ ID NO: 36349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccgaacaggactttgcaggactctgtttc

SEQ ID NO: 36350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccgaagcggctgacactgctcgtgtagcg

SEQ ID NO: 36351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccgacagtgttgcctccggcactggttcg

SEQ ID NO: 36352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccgaccggagagcgctcagcactcgccta

SEQ ID NO: 36353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccgcaatgtggcgtttgtgctttgtgcgc

SEQ ID NO: 36354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccgccaacgacaacttcataaaagttgct

SEQ ID NO: 36355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccgcgctgtcgttgttctggtcggctccg

SEQ ID NO: 36356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccgctctctggctgcgttgcttccccccg

SEQ ID NO: 36357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccgctgaatgttttgaacggtaggatcgt

SEQ ID NO: 36358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccggagatagttgtcaaaatatagatatt

SEQ ID NO: 36359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccggagtgcgcataatgggccgagcagtg

SEQ ID NO: 36360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccggcgggggctttgattgcctgttgatg

SEQ ID NO: 36361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccgggggcacactagactgggaagtggcg

SEQ ID NO: 36362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccgtaggaccgcgcactgcccggagactt

SEQ ID NO: 36363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccgtatgcactgccgtatttttcttttca

SEQ ID NO: 36364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccgtcgccagcactgaattagctcggact

SEQ ID NO: 36365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccgtgattcgtttaggtaatcgcggaggg

SEQ ID NO: 36366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccgtgcccatccgtatgctgttgcgatcc

SEQ ID NO: 36367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccgttatgctattcctgtttttgcgtatg

SEQ ID NO: 36368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaccgttgaattgctcggagacattggtgcg

SEQ ID NO: 36369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacctaatccgaaccctatgcagcaaccctc

SEQ ID NO: 36370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacctacgtattgtttttatgatagtcctgt

SEQ ID NO: 36371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacctaggctgaacggaggtactgtgtgttc

SEQ ID NO: 36372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacctcccgtcttcctaacagtattacgcgg

SEQ ID NO: 36373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacctcgatctccggcttagacagttgctgt

SEQ ID NO: 36374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacctcgccgccgcatggatacggtgcacgt

SEQ ID NO: 36375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacctcggatgagacctatctgacatcactc

SEQ ID NO: 36376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacctgagtgtctttacggcggtgggtagat

SEQ ID NO: 36377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacctgtcacatgcgtcttaatctcctcagt

SEQ ID NO: 36378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacctgtgcgcgcccgatggtgggccgggct

SEQ ID NO: 36379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgaacgggaagacccgcaggccgcggcgt

SEQ ID NO: 36380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgaactgagcaagcccaggatatcgagag

SEQ ID NO: 36381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgaattccacggttttactcccgcgatac

SEQ ID NO: 36382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgacaattttccccacagcgccgagtccc

SEQ ID NO: 36383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgacctctgcggcgctgtgttcagtgtct

SEQ ID NO: 36384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgacggtccaatatgctgccgtcgaagat

SEQ ID NO: 36385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgactttgcaggtttattgttatctttgc

SEQ ID NO: 36386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgagactcagagttcgggggtctgactct

SEQ ID NO: 36387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgagcacatcacttgacacggtaaggacg

SEQ ID NO: 36388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgaggggcgtcaggtcgtgctctcttcgt

SEQ ID NO: 36389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgagggtgctactgtgatacatccctgcc

SEQ ID NO: 36390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgaggtgcctaaggtaatgccatactcat

SEQ ID NO: 36391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgagtgggtttttcgtccaggtgcacccc

SEQ ID NO: 36392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgagtgtagcaggaatcaataagtgtcat

SEQ ID NO: 36393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgagtttgccacactggtatagcgcgttg

SEQ ID NO: 36394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgataaactcgcatatgtggctcctgggg

SEQ ID NO: 36395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgatacagtgcagtagtacggtaaattgg

SEQ ID NO: 36396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgatcaaaattggcacacaggatcaaatc

SEQ ID NO: 36397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgatcgatgggaagcgcgtactgctatag

SEQ ID NO: 36398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgatggctaacttgatctttcgcttggta

SEQ ID NO: 36399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgcaatgtccactggagtcgctcgtccgg

SEQ ID NO: 36400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgcaattctggttctatgcgtgccagtcc

SEQ ID NO: 36401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgcacactcccgcacgaccgtaatggcct

SEQ ID NO: 36402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgcacatggttggggaattaggactattc

SEQ ID NO: 36403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgcagagagtcacccggccgtgtgtcttc

SEQ ID NO: 36404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgcagagggactgatagcgtttcggcgtg

SEQ ID NO: 36405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgccacgcagcagatcgccgatagagagt

SEQ ID NO: 36406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgccacgtttgccatgtacatgcgcggta

SEQ ID NO: 36407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgccctgtgtgagcctccgttttttgatt

SEQ ID NO: 36408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgcgagaccgaattttctcgtaccttgcg

SEQ ID NO: 36409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgcgagggttgggaagttctccaacgccg

SEQ ID NO: 36410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgcgaggtagtattttcactgcgacccta

SEQ ID NO: 36411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgcgatgtgtaagggtatcttccttgcgg

SEQ ID NO: 36412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgcgctctgagcataggaaactggggatg

SEQ ID NO: 36413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgcggatcagaactggggaaggatcgggt

SEQ ID NO: 36414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgcgtagttggccttgggaaatgtcggac

SEQ ID NO: 36415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgcgtcaggctgtagcgggtatgagctta

SEQ ID NO: 36416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgctaacagggtgtcctttcgcccggata

SEQ ID NO: 36417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgctaacgagtgtggtcggacaccgtgtt

SEQ ID NO: 36418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgctaacgtgtacactacatttgacacct

SEQ ID NO: 36419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgctactgaccaattgagaccaactgccc

SEQ ID NO: 36420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgctatgcgaaggtcctgtattatctact

SEQ ID NO: 36421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgctgaccattgtcaagttttactggtgc

SEQ ID NO: 36422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgctgcggaggtattctgcagaccaacgg

SEQ ID NO: 36423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgctgctctcgggggattaaggatccgtt

SEQ ID NO: 36424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacggaagcaattatcttcggagtgctggtc

SEQ ID NO: 36425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacggacaggttctggtccgctcagggtgat

SEQ ID NO: 36426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacggactcgccatctcagtaagccagctat

SEQ ID NO: 36427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacggagaggtccactgggattgcttgctcg

SEQ ID NO: 36428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacggaggtactcggacctagtgcctggcct

SEQ ID NO: 36429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacggcacacaccctgagcctggcgtggcga

SEQ ID NO: 36430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacggcaccagaagcaccgcagccggggttg

SEQ ID NO: 36431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacggcacggaagtaagcgagttaatggcgc

SEQ ID NO: 36432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacggccgcgttgggactgggtaccggggaa

SEQ ID NO: 36433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgggaataagtgactacgctggctgatct

SEQ ID NO: 36434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgggagtcaagtttggtgttcggttaaac

SEQ ID NO: 36435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacggggcgtgtaaggtctaagggggggcgt

SEQ ID NO: 36436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacggggctaagagcttctagcgctccgata

SEQ ID NO: 36437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgggtaaccgatgttgctcgcaccctgcc

SEQ ID NO: 36438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgggtgcactgcttgggcatgctcatccc

SEQ ID NO: 36439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgggtgggagaaacgtcactccagtacga

SEQ ID NO: 36440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgggttttgcgtccccatcagatcttatc

SEQ ID NO: 36441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacggtacaagttagcgtgagaggccccggt

SEQ ID NO: 36442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacggtagcttctcggttacgcggctggagt

SEQ ID NO: 36443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacggtagggggaaggtctctactcgaggct

SEQ ID NO: 36444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacggtcgacgtgtccttcctcttgacttgg

SEQ ID NO: 36445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacggttcttatggcgttctgacactgagca

SEQ ID NO: 36446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacggtttttgacgtgctcgaaggtgtactt

SEQ ID NO: 36447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgtaacaacgtcgtgggaggattggctcc

SEQ ID NO: 36448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgtaagcgggagggcgaagtggacgtttt

SEQ ID NO: 36449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgtacagacttccagatcaccactaatcg

SEQ ID NO: 36450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgtacatttgtctctcggggcatatcttc

SEQ ID NO: 36451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgtcactgtacagtccttcgtgcagcgct

SEQ ID NO: 36452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgtcatagctcatttattggggttcatcg

SEQ ID NO: 36453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgtccccctctactggttgcgcataccgc

SEQ ID NO: 36454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgtcgccaatgacttgagtgtatgtcaag

SEQ ID NO: 36455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgtcttcagtctgtgccttggtgttaccg

SEQ ID NO: 36456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgtgaccttccccatgacccccgttacat

SEQ ID NO: 36457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgtgcataacaacaattcggttccgggct

SEQ ID NO: 36458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgtggggggttaatagccagctcaattcc

SEQ ID NO: 36459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgtgtctgtcggatcagtgtgaatttctc

SEQ ID NO: 36460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacgttcgatttcagcaggagattggccttt

SEQ ID NO: 36461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactaaatcgtattcgaagctatacattcat

SEQ ID NO: 36462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactaacctaccggcaacgcttaccctccgt

SEQ ID NO: 36463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactacataggggggccgcgaaatctgtgtc

SEQ ID NO: 36464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactacgtcactgctcctctgtgaacgcgtg

SEQ ID NO: 36465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactagatcgcgcgtgagatgatgagccccg

SEQ ID NO: 36466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactaggacgcaagggatcgttgatatgcgc

SEQ ID NO: 36467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactaggcgtcccaggagcgctactatcgtc

SEQ ID NO: 36468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactaggtgagacattttgttgcttaaccgt

SEQ ID NO: 36469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactatcacgatgacagggcagaacttgacg

SEQ ID NO: 36470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactattggatttggtattatagtgtcacaa

SEQ ID NO: 36471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactcaacggcacgggaggtttatgtttcac

SEQ ID NO: 36472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactcaataaacgtcgttaaggccaaacgtt

SEQ ID NO: 36473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactcagattgagagacgagagattacggcg

SEQ ID NO: 36474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactcagccgtggacacttgctacatcgttg

SEQ ID NO: 36475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactccctttcgggcacacggatggcccgtc

SEQ ID NO: 36476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactccgctaacgtttgaacctgcttgtcat

SEQ ID NO: 36477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactcgatttggatctgttgcgtttccgggt

SEQ ID NO: 36478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactcgcgcgacctggctctagtacttaccc

SEQ ID NO: 36479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactcggcccggtgttctgcaatataattcg

SEQ ID NO: 36480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactcgtactccctgcgctcgacattgtgca

SEQ ID NO: 36481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactctggggtacggtgtcaatggtcttacg

SEQ ID NO: 36482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactcttaaaaggcaggcccttcagttccgt

SEQ ID NO: 36483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactcttctcgtagctgcattcgactcttac

SEQ ID NO: 36484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactgaatccggaagtcagtggaacctttgc

SEQ ID NO: 36485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactgactcacacattttccgtgagttcatg

SEQ ID NO: 36486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactgaggggcgcgtctcgaaggtgtacgat

SEQ ID NO: 36487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactgatcggcggtgcatgttagcgttcatt

SEQ ID NO: 36488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactgattggtaactcctttccgaacgtagg

SEQ ID NO: 36489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactgcaaatgattgtcggggaaggagttgt

SEQ ID NO: 36490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactgcacgtcagtaggattgtctgggagga

SEQ ID NO: 36491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactgcagcgcgttgcggacccctctgtggt

SEQ ID NO: 36492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactgcccgccgatccttgttgcaactgttc

SEQ ID NO: 36493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactgccctctctgattattaatcctattcg

SEQ ID NO: 36494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactgccggtgtgtatggccgtaaggtgacc

SEQ ID NO: 36495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactgcgacgaatgtaacgtgcggcttaacc

SEQ ID NO: 36496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactgctgtggaagtctgatcgatcactttt

SEQ ID NO: 36497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactggatttgttgtatcggtcggacaatgc

SEQ ID NO: 36498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactggtggttcctttacgtcgttgagtccg

SEQ ID NO: 36499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactgtacggcgtttcctcggaaagtgtttg

SEQ ID NO: 36500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactgtcaacgtttggtttgagatcgtgtgc

SEQ ID NO: 36501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactgtttgggctcagattgacgacgcagcg

SEQ ID NO: 36502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacttaaaccagtaacaaagtgggggcatca

SEQ ID NO: 36503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacttacacggcggcgagctttccgttgctg

SEQ ID NO: 36504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacttacgctggccctgccggttcctgaact

SEQ ID NO: 36505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacttagcacgtgtcgtagatttatcctcct

SEQ ID NO: 36506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacttaggaccatacttccacgtttgcccgt

SEQ ID NO: 36507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacttcagcgggttgttttccggggtgggtt

SEQ ID NO: 36508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacttcggaacttccgtgcaaacgcctcggt

SEQ ID NO: 36509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacttctcacggctgacttttaatcagttta

SEQ ID NO: 36510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacttgcgaacgtttgcatggggttacgtgc

SEQ ID NO: 36511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacttggctgccaggagcgggtggtggatca

SEQ ID NO: 36512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacttgggactaagtttggagctattttgtc

SEQ ID NO: 36513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacttgtaatactctattacgacaatggatc

SEQ ID NO: 36514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactttgattcacaagcggaggatcgatatg

SEQ ID NO: 36515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactttggcatcactccggctgcacatgggg

SEQ ID NO: 36516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaactttggtgaggcctttttagacgactagg

SEQ ID NO: 36517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaacttttaggcgtggaaggcggtcgggaact

SEQ ID NO: 36518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaacatgtattgcggttctgcgtcccacc

SEQ ID NO: 36519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaacgcgccacatcaacagcctgaaaagg

SEQ ID NO: 36520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaagaacgaagtgccagcctccctatcta

SEQ ID NO: 36521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaagaacgatttcttgtagctttgcggtt

SEQ ID NO: 36522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaagcagtggtaagccggagagagatatc

SEQ ID NO: 36523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaaggtcagccttaacgtatggttacgag

SEQ ID NO: 36524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaatgggaggctccggcaattctggcggg

SEQ ID NO: 36525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagacaactggatcttttccaacggtcaagc

SEQ ID NO: 36526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagacacacagctttcccagcacacagcgcc

SEQ ID NO: 36527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagacacaggtgcggacgaacatcaccacac

SEQ ID NO: 36528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagacacatagaatacgtcatccccagtttg

SEQ ID NO: 36529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaccatcggctcgggtccggacgctgttg

SEQ ID NO: 36530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaccggcactccttaagtccgcctcgccc

SEQ ID NO: 36531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaccggcagaccgcgatggtttcgttggt

SEQ ID NO: 36532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagacgatacacaggctgtgaaaatcacttc

SEQ ID NO: 36533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagacgcttgaaaggaacggcaataccggaa

SEQ ID NO: 36534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagacggacgcaatttctcagggaacggtat

SEQ ID NO: 36535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagacggtgcgaacgaggcggtctgttgctg

SEQ ID NO: 36536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagacgtggagctggaaggactatagcggcc

SEQ ID NO: 36537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagactatacggtaccggccgtccatgtcat

SEQ ID NO: 36538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagactcctaatttatcctgcatcctccgtg

SEQ ID NO: 36539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagactcgcaggtggtccaccttacatgtgc

SEQ ID NO: 36540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagactggtttacccagccaaattctctccc

SEQ ID NO: 36541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagacttgagtccatgctggaagccgatcgt

SEQ ID NO: 36542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagacttgatgcaacactgcgcagatgtatc

SEQ ID NO: 36543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagagaagagagcatatagatgcttaagctg

SEQ ID NO: 36544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagagagcatgatcgacaatcacacgctcgc

SEQ ID NO: 36545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagagcacgcacatgtattgacttttcggtc

SEQ ID NO: 36546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagagcgagcgacttgagtttgcagccaaga

SEQ ID NO: 36547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagagcgcaggtggcctttgtagctgtcccg

SEQ ID NO: 36548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaggacgtccatgaggtaatcactctttg

SEQ ID NO: 36549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaggactacatgttatctgttggtgtacg

SEQ ID NO: 36550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaggagcaatgtagtacacgcatttcttt

SEQ ID NO: 36551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaggagtcgctccgtcgaattgttaactt

SEQ ID NO: 36552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaggatggcggccgtgggtgcggttagcg

SEQ ID NO: 36553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaggcactagaaggtcgggtgggcgtatt

SEQ ID NO: 36554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaggcataaaggcgaggtacttacgggcg

SEQ ID NO: 36555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaggcttaagatcttcaccgcgtatctgg

SEQ ID NO: 36556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagagggtttaggctctcgtaggatgaacgt

SEQ ID NO: 36557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagaggtaccgtacacggcttcagacttagg

SEQ ID NO: 36558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagatcagcctagccgtagacccgcggcgca

SEQ ID NO: 36559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagatctggatgtcgctatcgacgagttctg

SEQ ID NO: 36560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagatgaagcatgatgggtgaaatcggatta

SEQ ID NO: 36561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagatgacagcaatgggtgcacccaatcggg

SEQ ID NO: 36562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagattacactttcacgggacaagatatatt

SEQ ID NO: 36563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagattgcggactcgatcaaggtgccgtcca

SEQ ID NO: 36564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcaaaagtgattaagtggatctttggtag

SEQ ID NO: 36565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcaaagtgttaccaaaactcattcccacg

SEQ ID NO: 36566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcaaggggaactaattacgtttaggcatc

SEQ ID NO: 36567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcaatactttctgtgaagcagactgctca

SEQ ID NO: 36568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcaatcattacagacatcgtctagcctag

SEQ ID NO: 36569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcaatgcgtttcgaggcgactcgatgcat

SEQ ID NO: 36570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcacagggttcgaaccaaagatgcgcgtg

SEQ ID NO: 36571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcacgatatcttaccccacatgattgaca

SEQ ID NO: 36572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcacgcccaatcagttcttacgtcgttag

SEQ ID NO: 36573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcacggcgagcggacgttttctcgagctg

SEQ ID NO: 36574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcactccacaccgccttgtgttgaatgct

SEQ ID NO: 36575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcacttcaagggcgagcgggtaattatca

SEQ ID NO: 36576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcagaaatcaatttgcagccatacagagc

SEQ ID NO: 36577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcagaaggatcgccaaggcatcgggaccg

SEQ ID NO: 36578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcagaccgcaagttcgggctaatgttggc

SEQ ID NO: 36579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcagctgaccttggcaatgtgaatgtcac

SEQ ID NO: 36580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcatcggtcccctcgcacctgtgatcgtc

SEQ ID NO: 36581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcatctggtcgtgtaaagagcaatccacc

SEQ ID NO: 36582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcatgcagagccacacgctacgcgataag

SEQ ID NO: 36583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcatgctcgacctcgtggcatccatctac

SEQ ID NO: 36584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcatgggccacgccttagtctcgccggct

SEQ ID NO: 36585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcatgtgtctaatgaaatggcgcgtaagt

SEQ ID NO: 36586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcattcgggcagttaacaggtgcgcccgg

SEQ ID NO: 36587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcattcgtggatattctgtagggattttg

SEQ ID NO: 36588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagccaggagtttcgggcaggacgacggtaa

SEQ ID NO: 36589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagccatattcggcgtagagcaatgaggcac

SEQ ID NO: 36590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagccatcggtatcggcaggacgcagcgcgt

SEQ ID NO: 36591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagccgagcgcgccttatttctggccctggg

SEQ ID NO: 36592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagccgcaaccgcgtacacgcgctaatttct

SEQ ID NO: 36593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagccggtcaagaatgtcggacgaggtaatc

SEQ ID NO: 36594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagccgtccacgatacgattggatttctgcc

SEQ ID NO: 36595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcctcagtctcctcagtaatgatcttcac

SEQ ID NO: 36596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcctctgggacagcgtcaatgctcctacc

SEQ ID NO: 36597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagccttgccgcaccgttctagttgcctgag

SEQ ID NO: 36598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcgacgggtctccatgcttggttgcgtac

SEQ ID NO: 36599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcgagcaaaggactgttacgttttgccgg

SEQ ID NO: 36600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcgagtctgacggagttggcgacgggttc

SEQ ID NO: 36601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcgattatcctgttagatgcgcggcaacc

SEQ ID NO: 36602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcgcaacttacactgagaagagaccgcgg

SEQ ID NO: 36603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcgcaccatacgttgcgggcctccacggt

SEQ ID NO: 36604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcgcatgttttcagatcttataaaaaggg

SEQ ID NO: 36605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcgcgcgtgatctgtgtatgttctaccgt

SEQ ID NO: 36606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcgctgctaataccggtactgttcgggtc

SEQ ID NO: 36607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcggccagcgtttctcctcgtgtattttt

SEQ ID NO: 36608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcggccgcgtgcaacgttcaccatatgcg

SEQ ID NO: 36609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcggtacggcacacgagtgtcttggtgtt

SEQ ID NO: 36610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcggttgttctccgtacaatcccgtttgc

SEQ ID NO: 36611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcggttgtttcatccttcatgtacatggt

SEQ ID NO: 36612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcgtatcaggacaacctggtcacgtcgaa

SEQ ID NO: 36613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcgtatggaccgcgttggtggacgcaaga

SEQ ID NO: 36614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcgtcggatcgggcggggcttaagcagat

SEQ ID NO: 36615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcgtcgtccaggtaggattaagtcccggc

SEQ ID NO: 36616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcgtgcaacccgctcgctcttgtcctatt

SEQ ID NO: 36617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcgtggttaggagctacgtaacctccccg

SEQ ID NO: 36618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcgtttgtctaaacagatcgcgtcggttc

SEQ ID NO: 36619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagctaaccgagtcgtttccagtggttcaga

SEQ ID NO: 36620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagctagaaagtcgccgtcagacagaaagcg

SEQ ID NO: 36621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagctaggttttcgtgagctagtacatatgc

SEQ ID NO: 36622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagctcagggggaagggatggagagttaatc

SEQ ID NO: 36623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagctcatacgcactgatatccgctataaag

SEQ ID NO: 36624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagctcctgtcccgattggtctaatttcgtc

SEQ ID NO: 36625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagctcgtgggtaacgtctttttaactgcac

SEQ ID NO: 36626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagctgatcaacgacaacgcctcgtacaagt

SEQ ID NO: 36627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagctgcacatttaggttctaagcatggggc

SEQ ID NO: 36628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagctgcgtgtagagcgtacataaggaatct

SEQ ID NO: 36629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagctgctgtttcccaatttgcgctcgcgta

SEQ ID NO: 36630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagctgcttcgtgcgatcaatagtcttgtcc

SEQ ID NO: 36631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagctgtcggttcaagcatacacggctcccc

SEQ ID NO: 36632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcttgaaacacttattaagtaccgctcat

SEQ ID NO: 36633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcttgcctggtggggttaacccgggctgc

SEQ ID NO: 36634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcttggttggtaacacgtttgtaggcact

SEQ ID NO: 36635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagcttgtcttacgtgtccgtcgaacctcat

SEQ ID NO: 36636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagctttcacacggctccttggtcttacgcc

SEQ ID NO: 36637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagctttcactgttattaccacgattacgct

SEQ ID NO: 36638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggaattggcgccgagtagtaaaccggttc

SEQ ID NO: 36639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggacaattcgtaaaacgcttccaaaggtg

SEQ ID NO: 36640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggaccgacttctgtatttaaactactctt

SEQ ID NO: 36641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggagaacgtccaacttcaaatcgacgtaa

SEQ ID NO: 36642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggaggagacgctttgtactgcgccagcgc

SEQ ID NO: 36643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggaggaggaccatatcgatcctggtacgc

SEQ ID NO: 36644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggaggtcatgcttggaccgcttgagtcgt

SEQ ID NO: 36645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggatcacggtttttctatgtgtttaatat

SEQ ID NO: 36646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggatcgcctgcttaaatacggtagttcct

SEQ ID NO: 36647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggatggtggtcggaatggcatcgcggggc

SEQ ID NO: 36648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggattgattcgcgtgaggtgccttctacg

SEQ ID NO: 36649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggcaaactgcaacatagcttactggtcgc

SEQ ID NO: 36650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggcaatggtcggttgggcataatagtcta

SEQ ID NO: 36651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggcagcactccttgactgttactgttgat

SEQ ID NO: 36652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggcatggtggtgagatattattagggtgg

SEQ ID NO: 36653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggccagatgcacgtcagacacaggctcct

SEQ ID NO: 36654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggcccaaagctccatgtctgataaacgtc

SEQ ID NO: 36655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggcccatgaacgtttaagcttcatgctcc

SEQ ID NO: 36656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggcccggtttgggtgggtcattcttagtc

SEQ ID NO: 36657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggccgaaacgtttactgttattcagcgtt

SEQ ID NO: 36658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggcgaattggccgtttgacttgcgctcct

SEQ ID NO: 36659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggcgggcagcgcagcctcctaggtgctcg

SEQ ID NO: 36660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggcgtcgcagaatccaggagttggccatt

SEQ ID NO: 36661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggcgtctcgcgtatttatgttccgactgc

SEQ ID NO: 36662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggctcggaagcacaaacccagtgcacaat

SEQ ID NO: 36663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggctgatgctactatcatgaggtgggatg

SEQ ID NO: 36664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggctgatgtaggaggtttctgggtccaca

SEQ ID NO: 36665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggctgcatgggaaatggatcacctcaccg

SEQ ID NO: 36666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggcttggcttgtctcctccgaggtagctg

SEQ ID NO: 36667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagggaaacagaaggcgactgggggactggg

SEQ ID NO: 36668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagggacgttgtgccatgcggggttcgttca

SEQ ID NO: 36669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagggagcccgggccagtaatatcctgaggg

SEQ ID NO: 36670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagggagccgcttttgtaggccgatacatgc

SEQ ID NO: 36671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagggatgagacacgccactacacacaacgc

SEQ ID NO: 36672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagggatgcatgttatgtcagtaaaccgatc

SEQ ID NO: 36673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagggcagcacgctatttacgccgcacatta

SEQ ID NO: 36674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagggccacagacgatgtgctcacccctgtc

SEQ ID NO: 36675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagggcgaacatttagagtattccgccgcgg

SEQ ID NO: 36676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagggcgatagggtgccctactgtacatcga

SEQ ID NO: 36677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggggacggggggctggcgactccatgtgc

SEQ ID NO: 36678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagggggcgcttgctggaggccgcgtgtgta

SEQ ID NO: 36679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagggggctctcgaaattgcagtagatagga

SEQ ID NO: 36680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggggtaacctcggctagtacagtgacact

SEQ ID NO: 36681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagggtcaggaagggtgctatccgtggctgg

SEQ ID NO: 36682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagggtgcgccttgaatcggacgtaatgaga

SEQ ID NO: 36683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagggtgggtatgtctgtttcactgatccgg

SEQ ID NO: 36684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagggttcttgatgcacggtcccgttgttga

SEQ ID NO: 36685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagggttttgcgcgtatttgccggacaagat

SEQ ID NO: 36686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggtaacagtaacacaatgctgttttgaac

SEQ ID NO: 36687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggtagcaatcccagtcttactcatagtat

SEQ ID NO: 36688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggtatcaggcccacgatttcataagccta

SEQ ID NO: 36689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggtatgaataggacttagtgggggggctg

SEQ ID NO: 36690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggtccaactcccgacccgtggccatcgat

SEQ ID NO: 36691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggtgctccacgtaccaagtgtattttcaa

SEQ ID NO: 36692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggtgggaacgcatatatatagtcggaccg

SEQ ID NO: 36693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggtggtaagtcaaaccgagacctgctctg

SEQ ID NO: 36694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggttacttcactggtgactcctgacactg

SEQ ID NO: 36695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaaggttagtttgtaggtccacccggagtttt

SEQ ID NO: 36696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtacaacctcataggctgggctattttgg

SEQ ID NO: 36697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtacgcgggtggtttctctgcggcctgtg

SEQ ID NO: 36698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtacggtcccggagcttcgggaatctcgt

SEQ ID NO: 36699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtagaatactcgccgtctagtaactccct

SEQ ID NO: 36700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtagatacgtgatttcttctggatatctt

SEQ ID NO: 36701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtagattatgttcggtcgggcctgcgttc

SEQ ID NO: 36702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtagatttccgtaaatggcatccaccgta

SEQ ID NO: 36703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtagcacacggcgcgctgtcgaccgggct

SEQ ID NO: 36704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtaggcgatacctgagtgcaggccttatg

SEQ ID NO: 36705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtaggtcctgcacccgttgctgggtaata

SEQ ID NO: 36706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtatacggagtagcaaaacttgtgtaggt

SEQ ID NO: 36707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtatggaattcgtcctgactttccactca

SEQ ID NO: 36708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtattaccccatcaagggtgcttcgtctg

SEQ ID NO: 36709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtcaaatgggtagagggcagctcatacgc

SEQ ID NO: 36710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtcacccccgtcggcgccgtaagccatcc

SEQ ID NO: 36711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtcaccgtgttggttacggggaggaaccg

SEQ ID NO: 36712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtcagacggggccggtctttcttggtgtc

SEQ ID NO: 36713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtcagtaacgcagcatattgcgactgtgc

SEQ ID NO: 36714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtccacggcggcctaagtgatgcggctgc

SEQ ID NO: 36715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtccgcactgtgaagtgccgaaggtgggc

SEQ ID NO: 36716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtcgatgacggagcttcccgaaacgacaa

SEQ ID NO: 36717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtcgcttgttgtgttgtcaccaggcgtga

SEQ ID NO: 36718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtcgtataggattcgagatgctcgtgtgc

SEQ ID NO: 36719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtcgtgcattattacacagcttggggcgc

SEQ ID NO: 36720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtgaagttagcgacggccttgtgacaggt

SEQ ID NO: 36721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtgatcgctttgatcagtttagcaaggac

SEQ ID NO: 36722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtgcaccaacgcaatccaacagagcagct

SEQ ID NO: 36723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtgcgtcaaccaatacggcgacaacctct

SEQ ID NO: 36724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtgctgtgacaacacggacaagcctgcac

SEQ ID NO: 36725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtggagcctctttcacggtacaccagttt

SEQ ID NO: 36726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtggcaagtttgaactctcgggatcggtc

SEQ ID NO: 36727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtggggcgggcgtcattgtcgagtaacgg

SEQ ID NO: 36728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtgtaactgaccctcagttgcgtagcgtg

SEQ ID NO: 36729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtgtgcgtacagccgcggggtgtcctgac

SEQ ID NO: 36730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagtgttgggtgtttagtctttcctgatata

SEQ ID NO: 36731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagttagcagctttggttgcaacaatttccg

SEQ ID NO: 36732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagttcacactagttactctatttacgcctc

SEQ ID NO: 36733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagttcatagagggacggtccttgtttgccc

SEQ ID NO: 36734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagttcataggacttgcgcatgagtttccga

SEQ ID NO: 36735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagttccagcctcaatgtcactgtgtacagc

SEQ ID NO: 36736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagttgaccttagtgtccacggtatgactag

SEQ ID NO: 36737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagttgcatcgggccaacgcttgggcttgtg

SEQ ID NO: 36738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagttggaagtggctcagacggtcaaccctg

SEQ ID NO: 36739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaagttggcgggatagccacctggcaaacgtt

SEQ ID NO: 36740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaataaatggcaaaaactgatcccggagtgct

SEQ ID NO: 36741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaataacagtaccagcaggcgtggtatgtcgg

SEQ ID NO: 36742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaataacgtgcgcgaggttcgcggcggctagg

SEQ ID NO: 36743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaataactcggttggttgatttgtggggcttg

SEQ ID NO: 36744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaataagaaattctgaccttctcctcgtggct

SEQ ID NO: 36745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaataagacgacctggactccggagtctcgtg

SEQ ID NO: 36746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaataagtaggactcgaggtatcggcataatc

SEQ ID NO: 36747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaataagtgtcgaatttgggccattagacgca

SEQ ID NO: 36748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaataatcgcacgcagcatagacatactatcc

SEQ ID NO: 36749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatacaccgacgtcatccgtcatgtggcggc

SEQ ID NO: 36750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaataccgatcgtactagacggcgttagggtg

SEQ ID NO: 36751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaataccgctatcttatgaagcgttaatgcga

SEQ ID NO: 36752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatacctagttatcagtttagtgtcctataa

SEQ ID NO: 36753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatacctcgttgataacgtcgggatgtgtta

SEQ ID NO: 36754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatacgctcaattactgttcaacgagtcagc

SEQ ID NO: 36755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatacggtccctcgctgtgtcccgggctttg

SEQ ID NO: 36756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatactagggaagaaaaggagtcggttggac

SEQ ID NO: 36757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatactcgccttgcatccctagcctctcggc

SEQ ID NO: 36758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatacttctatgccgtccaagcgatcaatat

SEQ ID NO: 36759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatagaccaggaggccgcgctaatttccagc

SEQ ID NO: 36760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatagcaaacaccacagaaatgcgtcccgcg

SEQ ID NO: 36761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatagcacactaccccatgccggtcggaaga

SEQ ID NO: 36762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatagcacgggctcgcaaacggactatttac

SEQ ID NO: 36763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatagccctcgacgttagtgttgagcgtcga

SEQ ID NO: 36764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaataggcctgtcagcgctgatagaagaggct

SEQ ID NO: 36765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaataggcggaactcggggaatacggtgtcat

SEQ ID NO: 36766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatagggcctctatggagtagaccggttcgg

SEQ ID NO: 36767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatagtggcggagctggccctttcaatgcca

SEQ ID NO: 36768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatagtgtgcctcgggtgggaagtgtggtat

SEQ ID NO: 36769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatagttgagcacaacttttccgacccaggc

SEQ ID NO: 36770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatagttggtttgccgtgtgcgatcaatggt

SEQ ID NO: 36771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatataccgttcatggtccgcgttggccaga

SEQ ID NO: 36772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatatagagcgacgactctatgcctccaggc

SEQ ID NO: 36773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatatccgggggattcttcactcacttgcca

SEQ ID NO: 36774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatatctggctgactagtagtgcgatccagt

SEQ ID NO: 36775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatatgagaacgcgcatcggcgtgctctgcg

SEQ ID NO: 36776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatatgatagtctctctgaatgctgacgatt

SEQ ID NO: 36777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatatgatgacctagctgcatcttgaactga

SEQ ID NO: 36778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatatgctattcatgctgaacatcggccgat

SEQ ID NO: 36779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatatggaaggcggaggtttactctcttcgt

SEQ ID NO: 36780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatatggtgtccgcttttgcttattgaacgt

SEQ ID NO: 36781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatattaccactttattgttgttgtataacg

SEQ ID NO: 36782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatattatcccgcgaaaactcggcggccgtc

SEQ ID NO: 36783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatattgggaggccagagtctagctttcgca

SEQ ID NO: 36784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatatttgcagtgcgtccccaacagatactc

SEQ ID NO: 36785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcaaactcggatttcacagcttattacct

SEQ ID NO: 36786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcaaatgcatcgggttgttattggccgga

SEQ ID NO: 36787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcaacgtaaagtcccccatacgcaattgc

SEQ ID NO: 36788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcaacttcgatgtgtagttccaagggcaa

SEQ ID NO: 36789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcaagccgacccatcgttttaatcgcggg

SEQ ID NO: 36790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcaatccgatgattttcaagcccctgtac

SEQ ID NO: 36791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcacacgtacatggatcgcgagtgcaggt

SEQ ID NO: 36792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcaccacgcgccgcacatgcatatggact

SEQ ID NO: 36793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcacgtagcaatcaggcgctacagatccg

SEQ ID NO: 36794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcagcacctgatagtgtactcctggctcc

SEQ ID NO: 36795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcaggaaccgagtttctaatttgcgacct

SEQ ID NO: 36796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcaggtcctataggtgcaaagctttctac

SEQ ID NO: 36797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcagtgccttagtgtcctatgaagggcgt

SEQ ID NO: 36798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatccacggtttcctgcatactttcctttaa

SEQ ID NO: 36799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcccccatgacacgtatgtagctgtatcc

SEQ ID NO: 36800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcccctccacttcttacatctcgtgcatt

SEQ ID NO: 36801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcccgtgagacattcggagttactcgcct

SEQ ID NO: 36802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatccgagccaggtacggtagccgcttgacc

SEQ ID NO: 36803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatccgcacaacaattcggacttgggcggcc

SEQ ID NO: 36804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatccgcgttagcacgcaatgagtcggtggt

SEQ ID NO: 36805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatccggaagagacggtgtgcgtgatcgggc

SEQ ID NO: 36806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatccggatgggcctgctccgtacgccaggt

SEQ ID NO: 36807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatccgtacatcgcacgccgtgtggtaggca

SEQ ID NO: 36808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatccgtcgtcagtggctatgtgctcccatc

SEQ ID NO: 36809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcctctctgcggtgattttcggtgccggg

SEQ ID NO: 36810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatccttgtgacattttgctgtgcatcatcc

SEQ ID NO: 36811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcgaacgttagggattatggctaggttgt

SEQ ID NO: 36812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcgacgatttatgtatctcggttagtggc

SEQ ID NO: 36813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcgacggtagccgacgtacggtgtgatcg

SEQ ID NO: 36814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcgaggaccaggctgccgtccgaggccgc

SEQ ID NO: 36815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcgatacgagagcgtccacccacttggtt

SEQ ID NO: 36816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcgcaaccgaaactcccggacgagccgtc

SEQ ID NO: 36817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcgccagagggcgtcccaggacctgcact

SEQ ID NO: 36818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcgcctaaggtacgaggtttccagcttta

SEQ ID NO: 36819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcgcgttagcaaactagcgggataagttc

SEQ ID NO: 36820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcgctttaatgttagcgcgaagttcgtgg

SEQ ID NO: 36821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcggaccggcacacacgtttaactgtagg

SEQ ID NO: 36822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcgtacctcagctgtggttcaagcttggg

SEQ ID NO: 36823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcgtctcttcagtctagcggcattgctac

SEQ ID NO: 36824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcgttaacattaacctttgtgatcattga

SEQ ID NO: 36825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatctactggttgtttcccttgatgggcctg

SEQ ID NO: 36826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatctcagggacggacgtgtacagtgtttgg

SEQ ID NO: 36827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatctcataatcacgcgcaacgtatctaaca

SEQ ID NO: 36828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatctccaaccttcatatcctcaagcgtttc

SEQ ID NO: 36829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatctcgtacagagggggcgtggcttagggg

SEQ ID NO: 36830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatctggtccttggtataaggaggcgagtct

SEQ ID NO: 36831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcttaggacggacagtggcaagtgcctag

SEQ ID NO: 36832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcttcagcccttatggtcacggatcaagc

SEQ ID NO: 36833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatcttgcggttgttcctgcgcggcgtgcta

SEQ ID NO: 36834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgaacgtttcttttgtcgccgtcctttcc

SEQ ID NO: 36835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgaactaattggagagctgaggttcagag

SEQ ID NO: 36836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgaagaaacgaaagcaagccacaccaagg

SEQ ID NO: 36837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgaatccctcccgcctctatagctaggtt

SEQ ID NO: 36838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgaattcggtcgtatactaggcggcgtac

SEQ ID NO: 36839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgacatcctatttggtcctgggtgggcgg

SEQ ID NO: 36840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgacgaacgtcggccctatgctcctatcc

SEQ ID NO: 36841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgactgtacgtacggtgcgggaaagtttc

SEQ ID NO: 36842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgagacggaggaccttccgtaatgcatgt

SEQ ID NO: 36843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgagcgtgtaattcactactgtactcatg

SEQ ID NO: 36844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgaggttgttatggagagcgcgaacatat

SEQ ID NO: 36845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgataattgagcatggttatcggtccgtt

SEQ ID NO: 36846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgatgtacgtctcgatcgtttgtatttgg

SEQ ID NO: 36847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgcacggcggtaatgctacatattgatct

SEQ ID NO: 36848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgcactaaaaaatgcggcaagtctatact

SEQ ID NO: 36849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgcatgggggtctcggtgcacgattctaa

SEQ ID NO: 36850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgcccttgaaccgttacggctggggaaag

SEQ ID NO: 36851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgccgcccacctgcccgttgtcatcgaac

SEQ ID NO: 36852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgccgtttaaggggtgtcttctggttcgc

SEQ ID NO: 36853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgcctcggtgcgaaccagctagtttcgtt

SEQ ID NO: 36854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgccttgagttcaccacgatatcctgcgg

SEQ ID NO: 36855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgcgagttaaacggaaggtggtaatttac

SEQ ID NO: 36856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgcgccatggtggccacgctcactgaacc

SEQ ID NO: 36857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgcggggacaatcagtggcaccgcaggtg

SEQ ID NO: 36858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgcggtcgatctacctggttgtcgcttgt

SEQ ID NO: 36859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgcggtgtgtaggcgcaaccgctcgcgtc

SEQ ID NO: 36860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgcgtctattatctccatgggtctaggcg

SEQ ID NO: 36861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgcgtgccggatggactttcttcgcctgt

SEQ ID NO: 36862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgctaatcgataacgtcggctttgggtgg

SEQ ID NO: 36863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgctacggctgacgctatgtgtttagctg

SEQ ID NO: 36864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgctagccccgcgaaacatctgccttgct

SEQ ID NO: 36865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgctgtttgccctgcgagccgtttcttct

SEQ ID NO: 36866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatggaatattacacctcagtgatgttttat

SEQ ID NO: 36867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatggatctctgtggttggaatccgttttgc

SEQ ID NO: 36868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatggcaacgtgtcgggttttcatgccgctg

SEQ ID NO: 36869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatggcatgagaacaacaaggattctgggag

SEQ ID NO: 36870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatggccggctcgatagaatgtaagtgaagg

SEQ ID NO: 36871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatggcgagtctcgtcatatttgttggcact

SEQ ID NO: 36872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatggcgatgcaaagtacggttcctctcggc

SEQ ID NO: 36873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatggcgtccaaactccgcggttgaagcttc

SEQ ID NO: 36874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatggcgttgtatcggaatctcgacggcttt

SEQ ID NO: 36875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatggctcttcgtcggcgtttcgggcaggtg

SEQ ID NO: 36876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatggctgaatcgcgcgtgaactaaacgccg

SEQ ID NO: 36877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgggagctaccttggtcgttgccggaggg

SEQ ID NO: 36878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgggcagtcgctatttggcaacgcccccg

SEQ ID NO: 36879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgggcggaactgaacaagtaggctccggg

SEQ ID NO: 36880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatggggatgatcggccgaaccattgctgct

SEQ ID NO: 36881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgggtcagtcttgcggagctttgacattc

SEQ ID NO: 36882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatggtacatcttgggttggtatacggcgtg

SEQ ID NO: 36883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatggtatgacttgatcctttaggttgacga

SEQ ID NO: 36884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatggtccttctttggagcgttcatcgttgt

SEQ ID NO: 36885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatggtgcttcggttcgtagtcttctctggt

SEQ ID NO: 36886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatggtgtttagtgatagcaggttatgttct

SEQ ID NO: 36887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgtaagagttccttcataatccagccaac

SEQ ID NO: 36888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgtaagctgcattcggacttggtgattgc

SEQ ID NO: 36889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgtaccccgttctgctatgcgtcgatcgt

SEQ ID NO: 36890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgtactattacgcggtctgccctctagta

SEQ ID NO: 36891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgtagaggtaatcgtaagaccattcggcg

SEQ ID NO: 36892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgtatacttgaaccttagcgtgcgcaagc

SEQ ID NO: 36893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgtcaacgttcagtgttggtatcgagcgc

SEQ ID NO: 36894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgtcacggatgcgaacacaaggatgtacc

SEQ ID NO: 36895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgtcgtcattcaacaatatcgggcggtac

SEQ ID NO: 36896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgtcttcgcccgctacgaggccagtgtgg

SEQ ID NO: 36897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgtgcgattcatagtttttctacgctttg

SEQ ID NO: 36898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgtggaggtcacttggcaccggtttcgga

SEQ ID NO: 36899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgtggatgcaggcatgggtgcgcgagtcg

SEQ ID NO: 36900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgtgggttaggctaaaagcacgtcgcttc

SEQ ID NO: 36901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgtgttctaaggcgctcctgctaacactc

SEQ ID NO: 36902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgttaagtgcaaatcgagcggcctgctgt

SEQ ID NO: 36903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgttataactaacatggctgcatgacaag

SEQ ID NO: 36904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgttgaagttcttgtaattctcgtcgtaa

SEQ ID NO: 36905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgttgaatgaggctctgaccctctgagtc

SEQ ID NO: 36906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatgttgggggccagtgtcgcatagagagtg

SEQ ID NO: 36907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattaaactgccggaaggcctttttgtagtg

SEQ ID NO: 36908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattaacctgaacaacgggttatttctgaag

SEQ ID NO: 36909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattaagagtctcttgaggaccttatcgagg

SEQ ID NO: 36910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattacgcgtagtaggtctggctttgcgagg

SEQ ID NO: 36911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattacgctccgaggcgatattgggggcacg

SEQ ID NO: 36912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattacggtccgtgtaatccggtggactgtc

SEQ ID NO: 36913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattagcctgggagtatcatgccacggcctc

SEQ ID NO: 36914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattagggcatccgacttgtgtttttctagt

SEQ ID NO: 36915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattagtcgcggaaaaatcatgccctcctga

SEQ ID NO: 36916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattatatccagttcgtaggcgacggtgcat

SEQ ID NO: 36917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattatcgggtggacaggtgggtgagcgtcc

SEQ ID NO: 36918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattcaaaaatgtgatttgacaatagacacg

SEQ ID NO: 36919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattcagctgagtcgtacgcggatcagcggg

SEQ ID NO: 36920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattccatcctttttcttttctgcagacaaa

SEQ ID NO: 36921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattccgtaagccggttccgggatattgcga

SEQ ID NO: 36922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattcctctagttttcacatatctggtttat

SEQ ID NO: 36923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattctaacgcagctgtttacaccctgattg

SEQ ID NO: 36924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattctatgaaagtttatccgcgggcatgac

SEQ ID NO: 36925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattctcgggcgtgggaggtagcgtaggctg

SEQ ID NO: 36926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattcttcttacgtatttcgtcagcgcgctg

SEQ ID NO: 36927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattcttgcttcagcgcgcagtgtatgccgt

SEQ ID NO: 36928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattcttgtgggttgaatatacgcgtttgct

SEQ ID NO: 36929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattgagatctcggtcgacaggtttcccaag

SEQ ID NO: 36930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattgaggcatcgaggattcgacgcgtattc

SEQ ID NO: 36931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattgagtaactgcaatacgtcaggcataaa

SEQ ID NO: 36932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattgatggcacttactgtagttgaggaccc

SEQ ID NO: 36933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattgcagcgtcgggtttgttgccattgcta

SEQ ID NO: 36934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattgcaggcgacgacagcagcgagtgagga

SEQ ID NO: 36935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattgccggcaaatgctttaatgcttatgcg

SEQ ID NO: 36936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattgccttgtcgtaatatgtaacgtggcat

SEQ ID NO: 36937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattgctgcttttcgaatactattcctcctt

SEQ ID NO: 36938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattggaaggcacttagtccaaagcaagagc

SEQ ID NO: 36939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattggcagccactggtcgagattgcggccg

SEQ ID NO: 36940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattggctttgtgcgcggatctaggcgaccc

SEQ ID NO: 36941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattgggacgacacggactcatagctccttg

SEQ ID NO: 36942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattgggagggtaatgaggcgggatcgtgag

SEQ ID NO: 36943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattgtggtagagtgtgatgttgtgctttca

SEQ ID NO: 36944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatttatcgacgggggcgatgtatgggggtc

SEQ ID NO: 36945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatttccgctggcagacggtcgccggtgcgc

SEQ ID NO: 36946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatttccgtggcgggaagttgaaatatcggt

SEQ ID NO: 36947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatttgatcagtcttgatggtgatcgtgtcg

SEQ ID NO: 36948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatttgcgctttttcgaaccgtgtttggagc

SEQ ID NO: 36949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaatttgtgatagagaacgacatggttagaga

SEQ ID NO: 36950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaattttagacctttgtactcgtccagtctgg

SEQ ID NO: 36951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaaacggtaacggtcttcgaggccaatct

SEQ ID NO: 36952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaaagcgggattacgtgcggcggatccca

SEQ ID NO: 36953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaacatgttggtctgtacaacgctggcct

SEQ ID NO: 36954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaaccggcctcattacattatctaggcga

SEQ ID NO: 36955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaactacctgattgcgcagaacggtggca

SEQ ID NO: 36956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaagcgggtaccttgagtcgtgaatttcc

SEQ ID NO: 36957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaaggatttgccttgcatatggccaatgt

SEQ ID NO: 36958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaaggggttatcatagctgcggtgaagcg

SEQ ID NO: 36959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaagtagacgaagtgactccacaaaatcc

SEQ ID NO: 36960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaagtcaggagacattaggtatcgtaatc

SEQ ID NO: 36961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaagtcatggggtccaggtctcgttaatt

SEQ ID NO: 36962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaagtgggcggtttggtggcatagcgctc

SEQ ID NO: 36963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaatagaatgatggtcatttccaatgcgg

SEQ ID NO: 36964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaatagcctgttatggggggtctacgggt

SEQ ID NO: 36965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaatggatgggtacatcacgaaactcggg

SEQ ID NO: 36966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaattctgcccttaatactcggtgcacga

SEQ ID NO: 36967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaacaagtctaacagagtaacgcatagcct

SEQ ID NO: 36968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaacacgcacctattgccgtcgtttgtatt

SEQ ID NO: 36969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaacacgctgtaatggctgaccctgccagg

SEQ ID NO: 36970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaacaggtggagtgcaaatcctagtggcgc

SEQ ID NO: 36971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaccaacgcacattttggcctttggtctc

SEQ ID NO: 36972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaacccacaagacgcacgaacagcctgtga

SEQ ID NO: 36973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaacgagcccagggcagacgcgggcgttgg

SEQ ID NO: 36974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaacggccagcgcgcttgttgtacacgtgt

SEQ ID NO: 36975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaacggtacgcgtattgaatgagtgggggc

SEQ ID NO: 36976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaacgtttggcctgatacgtaggcaggcac

SEQ ID NO: 36977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaactcatttgcactattaccgtttagtct

SEQ ID NO: 36978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaactcgaggctccgtattcagcgtctctg

SEQ ID NO: 36979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaagaaccccttcgtattcacgctatctgc

SEQ ID NO: 36980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaagaatgagccagtttagtcgatcctcct

SEQ ID NO: 36981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaagactgttccattgcggtataacgtcgg

SEQ ID NO: 36982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaagagaggtggagctgtcccatgggcgtg

SEQ ID NO: 36983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaagattagtcctatccgaacttccgtccg

SEQ ID NO: 36984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaagcaaccaggagggtgttttgcactgcc

SEQ ID NO: 36985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaagcactactgaacaggccacaaatatcg

SEQ ID NO: 36986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaagcgcccggtactatgcaatccactcgg

SEQ ID NO: 36987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaagctggttattgttcccatccggctcta

SEQ ID NO: 36988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaggagggacagatagctggatggcacgt

SEQ ID NO: 36989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaggatcgaacgcctcagttggtgtacta

SEQ ID NO: 36990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaggatgggatcttctgccacagatgcta

SEQ ID NO: 36991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaggcgagccgagatattacgccggggat

SEQ ID NO: 36992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaaggcgttgacctcacagaaatcgtgggc

SEQ ID NO: 36993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaagggtatttgtcatgtcagtcccacgtg

SEQ ID NO: 36994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaagggtcggctttgaacttcgtttcttcg

SEQ ID NO: 36995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaagtacgatttgggcatgtgatggtttga

SEQ ID NO: 36996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaagtcggacgcgtatgcgttctgtggcgt

SEQ ID NO: 36997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaagttggtgtatcgagtgatcttcttcga

SEQ ID NO: 36998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaagtttggtctttgcataacattcaaccg

SEQ ID NO: 36999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaataatatattacgtcgtgtaatgcctgg

SEQ ID NO: 37000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaatagactgggacgactatagaaggggct

SEQ ID NO: 37001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaatataggtgtttacgacctcatcccatt

SEQ ID NO: 37002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaatatcgtgaaaatcgagttacccggatg

SEQ ID NO: 37003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaatccaaagttgctatctggacgcgtttg

SEQ ID NO: 37004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaatcgttcgttgcgcaagactcgtactat

SEQ ID NO: 37005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaatgcgcggtccaagtaacagtacaaaag

SEQ ID NO: 37006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaatggagtggcttgaatgcttggtttccc

SEQ ID NO: 37007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaatggcgtggaaagagtcgaaccgccacc

SEQ ID NO: 37008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaatggggatgtgtgtgtcacgagataccg

SEQ ID NO: 37009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaatggtcgctccaagtaacgggcctggat

SEQ ID NO: 37010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaattatcctgcgtgtggccagtctgacac

SEQ ID NO: 37011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaattgttctgtggtgtttatgttgctgtt

SEQ ID NO: 37012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaatttatagatggtgaatttgcgagtgtt

SEQ ID NO: 37013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacaaaccgggaggagaacaagtggcgcga

SEQ ID NO: 37014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacaaccccgatagaatacggcgtccgcgg

SEQ ID NO: 37015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacaatggcggtgtggcgaagcttgggtgt

SEQ ID NO: 37016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacaatggtttaacttgtttatataggtct

SEQ ID NO: 37017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacacatcccgtactggttcgggagtgctg

SEQ ID NO: 37018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacacgagtagcataccctcagggtgttgt

SEQ ID NO: 37019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacactcttggttccttgtgttcatgacgg

SEQ ID NO: 37020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacagcccgcctgatgatgccgatcgcggg

SEQ ID NO: 37021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacagcgcgcttgatcacggaggtgtggcg

SEQ ID NO: 37022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacagcgggatgattggatcgccaagcatc

SEQ ID NO: 37023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacaggctaaggtactgcgatccgccacgt

SEQ ID NO: 37024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacagggaccagtcgcatcgggtacgcggt

SEQ ID NO: 37025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacagtgccgtcgggccatcccccacactt

SEQ ID NO: 37026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacatacggtgttggggccgcggtgttcca

SEQ ID NO: 37027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacattgcttatatacgctgtatttatgcg

SEQ ID NO: 37028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacatttggcatcgcgagtggagacgcctc

SEQ ID NO: 37029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaccaagagccagcatgctcaaaaagcgcg

SEQ ID NO: 37030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaccaggcaaagtgaggcttaatttgactg

SEQ ID NO: 37031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaccagtcacgcatttgaccggggacaggc

SEQ ID NO: 37032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacccactgtgcgcggtcggtttgacttgc

SEQ ID NO: 37033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaccccccgagagcggctcgtgcccgcatg

SEQ ID NO: 37034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacccccgataccgctactaactacgggct

SEQ ID NO: 37035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacccgtcaccattcagctgctgcataagc

SEQ ID NO: 37036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaccgaatcgttaattccgactagtgagat

SEQ ID NO: 37037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaccgattacgatagtgctcgttgtttggg

SEQ ID NO: 37038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaccgattttggaacttgattataggaacg

SEQ ID NO: 37039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaccgcaaccggtcatgttaaagccacgtg

SEQ ID NO: 37040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaccgcatcgtttggtgcggaatctgtcac

SEQ ID NO: 37041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaccgcgttgtttccaggtggcacttgaac

SEQ ID NO: 37042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaccggaggtcgcgacaggaaaaatgcttg

SEQ ID NO: 37043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaccggccgagtcggattcagggacgtagc

SEQ ID NO: 37044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaccgggcaggtcactagacggctctatgc

SEQ ID NO: 37045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaccggttgagctggtaggtattaatctcg

SEQ ID NO: 37046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaccgtacatgcggctagccggcaacgtga

SEQ ID NO: 37047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacctccattctggtggctatgcatcgatt

SEQ ID NO: 37048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacctctatggaactgttttcagagtaatg

SEQ ID NO: 37049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacctgctcgcatttatgagtggtccgggc

SEQ ID NO: 37050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaccttccgggactgggcgcaggactagta

SEQ ID NO: 37051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgaacaagcggataggtctggcatgcgg

SEQ ID NO: 37052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgaacgaccacctcgcgtttgattccgt

SEQ ID NO: 37053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgagctcaatggattaaacgtccactcg

SEQ ID NO: 37054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgaggaagtgtcgcgtgccttcgttggc

SEQ ID NO: 37055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgatcaggcacggcggaatacgtctctc

SEQ ID NO: 37056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgatgctagcgggacatgggtataggta

SEQ ID NO: 37057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgattctcctcgcacatagcactggcgg

SEQ ID NO: 37058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgccgcggttttttcgtgtgacgtttgg

SEQ ID NO: 37059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgcgaattggtctcctttccccgactac

SEQ ID NO: 37060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgcgcaaccgatgacaagtcgtggtttg

SEQ ID NO: 37061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgcggcagctggtacattgtcggatggg

SEQ ID NO: 37062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgcgtgcgcccgtttgactcgacgagct

SEQ ID NO: 37063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgctgcgcggagactcttgccgacgtcg

SEQ ID NO: 37064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgctggcacgacggactcgcggagtgac

SEQ ID NO: 37065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgcttgcctagctttgtgagatgtgtac

SEQ ID NO: 37066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacggaacgcattaggctcatggaagctcg

SEQ ID NO: 37067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacggacaagggactaccgcctcgatggga

SEQ ID NO: 37068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacggactgtctagatctgagttgctagga

SEQ ID NO: 37069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacggctcatttccttgattgatcgtattc

SEQ ID NO: 37070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacggtaagggtctcgggtttggtggcctt

SEQ ID NO: 37071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacggtcccaatgcatcaagtgacttgacg

SEQ ID NO: 37072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacggttgttactggagcacgggcttggcg

SEQ ID NO: 37073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgtagcattccggcttaggaagttttgg

SEQ ID NO: 37074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgtgacgctgtcaagtgggctaggtgca

SEQ ID NO: 37075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgttaacacattcggaacgttattttag

SEQ ID NO: 37076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacgttataaatcgatgtagtctccagtgc

SEQ ID NO: 37077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacactaaccgggctgggaagaccactgatgc

SEQ ID NO: 37078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacactacgagtccacttcataggctcccgtg

SEQ ID NO: 37079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacactagagggaggccacggaccacagtcgg

SEQ ID NO: 37080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacactaggcaaacaggggagataactgctcg

SEQ ID NO: 37081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacactaggcacctgatggtacactgctacgt

SEQ ID NO: 37082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacactagtaaagcaggaaacgactctggata

SEQ ID NO: 37083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacactatcggcgtcggtgcgatttccggaca

SEQ ID NO: 37084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacactcaatcggtgattcaatttcgctcccg

SEQ ID NO: 37085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacactccgcagctggcgtctgactgaccgcg

SEQ ID NO: 37086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacactccttcccggcggactttatcattgca

SEQ ID NO: 37087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacactcgcatgatagagtacgtggtgccgtt

SEQ ID NO: 37088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacactcgtcggccccgggaacttgttatggg

SEQ ID NO: 37089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacactctcgcttaataagtcacgccaacggt

SEQ ID NO: 37090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacactgctctgtacgaactgcgcgggctcct

SEQ ID NO: 37091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacttcgaccggcaaacgtgtatacaatcg

SEQ ID NO: 37092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacttcgccccgggcacggtaaggatcaac

SEQ ID NO: 37093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacacttgcggcttctttattcgttggtctgt

SEQ ID NO: 37094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacactttcactgatccgtttatgatgttgca

SEQ ID NO: 37095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagaaagtacgataatgcatcatcgcctac

SEQ ID NO: 37096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagaatcactgaagtgaagtgaccgggaga

SEQ ID NO: 37097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagacacgcgggcgcctggacagtgctcaa

SEQ ID NO: 37098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagacccgtcctacacgtttcgctatgtcc

SEQ ID NO: 37099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagacgaaaatctcagtgctgtgaagtgta

SEQ ID NO: 37100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagacgacgtgactgtaagacagcccacat

SEQ ID NO: 37101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagacgagtgtccggagcaatctgctgggg

SEQ ID NO: 37102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagacgatccttctataatttacgagattc

SEQ ID NO: 37103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagacgttaacgaaggtggggcgtgcgtgg

SEQ ID NO: 37104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagagcacgatctggatgcgaagattatga

SEQ ID NO: 37105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagagccctttattcggtcgtacgctactt

SEQ ID NO: 37106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagagctgtacgggacctcctgttgtgttt

SEQ ID NO: 37107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagaggtctctctggttgtccgctttcctc

SEQ ID NO: 37108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagaggtgtgatctgaatatttcggtgtca

SEQ ID NO: 37109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagataatctgtgtacgtctccattctgct

SEQ ID NO: 37110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagatacatgtcggtacaggtttcttgtat

SEQ ID NO: 37111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagatcgcaatcaggccccgtcttatcggc

SEQ ID NO: 37112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagatgctgacggggatgttgatttcggcg

SEQ ID NO: 37113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagatgtgtacgtggccgctgtggttgccc

SEQ ID NO: 37114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcaactcggtctcggtttaggggctatt

SEQ ID NO: 37115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcaatacagatctttcaagtatagctaa

SEQ ID NO: 37116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcaatgatcgacgtcgtcgcgcaatgca

SEQ ID NO: 37117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcacggttactcggtaatgtgccgtaac

SEQ ID NO: 37118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcactaggggatgtgtgggcgcacgctc

SEQ ID NO: 37119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcagttcagttgaggcacatccttcccc

SEQ ID NO: 37120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcatccaggctcccttcgtagagtgtgt

SEQ ID NO: 37121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcatgacgtcggttctgcgctgggcttg

SEQ ID NO: 37122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagccaaatgcgcagtgaacaagtctgcca

SEQ ID NO: 37123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcccaacgtttgatggcactcgatggaa

SEQ ID NO: 37124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagccctcgacaaacaagtgtgttatgtct

SEQ ID NO: 37125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagccgacacaccagccttcctgggcagct

SEQ ID NO: 37126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagccgatacaaaccgggccgctaagctgg

SEQ ID NO: 37127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcctaaactgcgtgggccactggtagct

SEQ ID NO: 37128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcctagtcccgcatcacgcgtgtacccg

SEQ ID NO: 37129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcctcggcgtaccgctcttaacaactgc

SEQ ID NO: 37130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcctcgttcggccacttttcgtaacgcc

SEQ ID NO: 37131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcgaacggaaagcctcatgcgggtggta

SEQ ID NO: 37132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcgaaggtgcgaacggtcaaggggtcgt

SEQ ID NO: 37133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcgagtgatagtatcaggggaggagttg

SEQ ID NO: 37134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcgcacatggagtgttagtagtgtaacg

SEQ ID NO: 37135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcgcgcctaacaacaatggtatgcgggt

SEQ ID NO: 37136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcgctgagtttaccggttcggcagggac

SEQ ID NO: 37137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcggacggataatttgttagtctccggg

SEQ ID NO: 37138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcggggcacaagccatgtatctactccg

SEQ ID NO: 37139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcggtagtgtccaatcaggaacctcctt

SEQ ID NO: 37140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcggtccgcgacaatagctgtgagatgg

SEQ ID NO: 37141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcggttttggtttccgtagtttataacg

SEQ ID NO: 37142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagctagggatcccctgggtactgttggat

SEQ ID NO: 37143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagctgcactcttggcgtatcattttttta

SEQ ID NO: 37144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagctgccatgcaacctactccggtcacat

SEQ ID NO: 37145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcttagacctagaccagggttgcctcct

SEQ ID NO: 37146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagcttggtcttaggctccccgtgacgagg

SEQ ID NO: 37147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggaagcagtcggtgagtgtccaggttat

SEQ ID NO: 37148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggaccctagtgtcccatgcccttctgcg

SEQ ID NO: 37149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggacggaggggattgactaatgctgtgc

SEQ ID NO: 37150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggactgattcctcatatctcgagctctg

SEQ ID NO: 37151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggagttgtcacggtcagtggtgcagttg

SEQ ID NO: 37152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggataccagctattcactgtgactttgc

SEQ ID NO: 37153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggatcccgagaacttccatgccggccgt

SEQ ID NO: 37154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggcagcgacaaatacggttcccgaagtg

SEQ ID NO: 37155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggcctattgaaatggaattcttgcatcc

SEQ ID NO: 37156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggcgatcagggggttagagtcgggatac

SEQ ID NO: 37157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggcgcacgggcggattggagagcgcggg

SEQ ID NO: 37158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggcgctcaaaacggttcacctagtgggt

SEQ ID NO: 37159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggcgtccattagccctggcatcgcaacg

SEQ ID NO: 37160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggctaaagttacgtacgcgtactttgtt

SEQ ID NO: 37161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagggaatggaggccgccttactctgcctg

SEQ ID NO: 37162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagggacctatggcgtgtgctgctaacgtt

SEQ ID NO: 37163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagggactgagcggcttacgttcattcggt

SEQ ID NO: 37164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggggggacgcagcacaggcttgcagggt

SEQ ID NO: 37165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggggttttggagctcggccttatcacgg

SEQ ID NO: 37166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagggttaaagtgcccgtggatggaacggt

SEQ ID NO: 37167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagggttggacagcgtcactagtgcgctga

SEQ ID NO: 37168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggtaccccgggcacgaaatcgacggtcg

SEQ ID NO: 37169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggtaggccagaaccgcagttttgcgtcg

SEQ ID NO: 37170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggtctgagtacgtctgcagaatcatcat

SEQ ID NO: 37171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggtgagcaggactcgtacagcctgggca

SEQ ID NO: 37172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggtgcagtcaggcgaattagattatgtg

SEQ ID NO: 37173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggtgggtggtcaggcagcgacaggcagg

SEQ ID NO: 37174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggtggtggttgatgggtatagagttggg

SEQ ID NO: 37175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacaggtgtttagcatgactttgcggtgtagg

SEQ ID NO: 37176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtactcaatctgtgcgccatgtgctcgc

SEQ ID NO: 37177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtcacaattcagccgtctattttgagtg

SEQ ID NO: 37178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtcatatgtcgtgttgtgctggtatgcc

SEQ ID NO: 37179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtccaacaccaatgcccacctcctgtgc

SEQ ID NO: 37180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtcgttaaaaatttctccggtacccgtg

SEQ ID NO: 37181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtctccggagctggcgacttcgcggtgg

SEQ ID NO: 37182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtctccgtatacttacactcatatggca

SEQ ID NO: 37183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtcttgaagctacggggtacgcagtcgg

SEQ ID NO: 37184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtgacagaaattgcggaccagttggata

SEQ ID NO: 37185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtgactggtattgtgtttgcgcagtgtc

SEQ ID NO: 37186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtgagaattgaaagggagtaagtcttga

SEQ ID NO: 37187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtgattaaggagagctggtgctctgtgg

SEQ ID NO: 37188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtgcagttcatccagcagctcgtttgcg

SEQ ID NO: 37189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtgccggtatccagccgcctctgaaggc

SEQ ID NO: 37190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtgggccatgggattgggggttcgcaga

SEQ ID NO: 37191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtggggcgctactaatccaatcaggttc

SEQ ID NO: 37192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtggtgaggtaatgttagggtttttgta

SEQ ID NO: 37193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtgtagcacagaattggggcggtcacgg

SEQ ID NO: 37194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtgttagagtggttaactctaccgactt

SEQ ID NO: 37195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagttcagggcctgaattcttggtgttcgt

SEQ ID NO: 37196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagttcccgagtttaacatagggtgcgaga

SEQ ID NO: 37197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagttcggggcaatacgtaatctcgtaacg

SEQ ID NO: 37198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagttgcacgaaagtaactggtttgaatga

SEQ ID NO: 37199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagttttcgttctcctcggttgttctttgc

SEQ ID NO: 37200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacagtttttctctgggtaggcatcgatttta

SEQ ID NO: 37201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacataatgcgaaggggatgcgaaggggctgc

SEQ ID NO: 37202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatacatctgacagtatacacattttgcgt

SEQ ID NO: 37203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacataggaccgcatgagacagtgtgtgcgtg

SEQ ID NO: 37204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacataggtcaaggctgtaaccggatgcgctc

SEQ ID NO: 37205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacataggtccaatggctcaaggggtgtgcgc

SEQ ID NO: 37206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatagtacggtcgacatcccgtgggtgcgt

SEQ ID NO: 37207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatagtcgaacggagccgcgtagcaaccct

SEQ ID NO: 37208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatagtgtatatctacgtttgagggaaggg

SEQ ID NO: 37209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatatagctcctctttttactgtttttgat

SEQ ID NO: 37210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatatcatagaggacgaattgccccgacgc

SEQ ID NO: 37211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatatcccgccatgaatttttccagtagtg

SEQ ID NO: 37212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatatggtcccgcgtgatatgtatattgct

SEQ ID NO: 37213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatattcgccgatgagtagaatgtgcacgc

SEQ ID NO: 37214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatatttcttcagtgatgaaaatcagggcg

SEQ ID NO: 37215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatcaagggtttgctgcacacaccagtcga

SEQ ID NO: 37216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatcacgtgccggtcgctttgcctataatg

SEQ ID NO: 37217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatcagaaggtgaacggagccgacgtgcta

SEQ ID NO: 37218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatcattttcttctggtccgtatctgctca

SEQ ID NO: 37219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatccagacgtatcaagtatggactcttta

SEQ ID NO: 37220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatccataccgaaaaggcagtctataagta

SEQ ID NO: 37221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatccgattcctgttacatgggcaagcgag

SEQ ID NO: 37222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatccggaggaattctggcggtgtggatgt

SEQ ID NO: 37223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatccggtttcgggttttagcacgcagctc

SEQ ID NO: 37224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatccgtgcttctctagaatgatgctacat

SEQ ID NO: 37225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatcgaacgttatcgtaccccgcttcaaat

SEQ ID NO: 37226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatcgaactcccgatttactcactgatctg

SEQ ID NO: 37227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatcgaatggaaggcggcagggtgttgatg

SEQ ID NO: 37228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatcgacattgaagtgccctttaacttggc

SEQ ID NO: 37229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatcggatcaatttcacgggtcccacctcg

SEQ ID NO: 37230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatcggggtcatgtttcttgctttttaggt

SEQ ID NO: 37231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatcgggtgcagcactttacatctagcgcc

SEQ ID NO: 37232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatcgggtttgcaactcccatccgttttga

SEQ ID NO: 37233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatcgttgcagggttcgctaagtgccaggc

SEQ ID NO: 37234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatctagcagttccggttcggatgcacgca

SEQ ID NO: 37235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatctatcggcgcgctaatatcatcttggg

SEQ ID NO: 37236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatctgtctttcctctgcttgaaaggtgga

SEQ ID NO: 37237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatgaagggcggctttgcgtcttttggtgt

SEQ ID NO: 37238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatgacctccttcggcgtcctgtgttgcgt

SEQ ID NO: 37239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatgaggaggccgccctccccgacgcatat

SEQ ID NO: 37240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatgatgcaaggattgcgcatccgttgtgg

SEQ ID NO: 37241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatgcataaaaccctttctcgcgcaggaga

SEQ ID NO: 37242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatgcggccagcatactcctctgcgtatgg

SEQ ID NO: 37243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatgcggccgggctttatcatggagacagg

SEQ ID NO: 37244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatgcgtaagttgagagtccatggccaatg

SEQ ID NO: 37245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatgcgttatggttcacgtccgtttaacgc

SEQ ID NO: 37246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatgcttcgtttgtatgggtcacatgttta

SEQ ID NO: 37247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatgctttctcggtgggtttcgggactccg

SEQ ID NO: 37248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatggaccacacagtggtaagtcgctttag

SEQ ID NO: 37249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatggagctttctgatggatgctgctcgcg

SEQ ID NO: 37250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatggctcgtcaactgtggcccccgtcagg

SEQ ID NO: 37251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatgggaggacccacctaagccacggagca

SEQ ID NO: 37252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatgggataatttacagatttggctatctg

SEQ ID NO: 37253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatgggtgacgcgggttgttctcatttccg

SEQ ID NO: 37254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatggttgtttatgtgcgttctcccgtcgt

SEQ ID NO: 37255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatgtaccgagagcctgaccttggggtaac

SEQ ID NO: 37256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatgtgggtttaatctaccgtgggatctgt

SEQ ID NO: 37257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatgtggttcaccggccaagacacaggtgg

SEQ ID NO: 37258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattaaaagtcggctaatagcgaagcccac

SEQ ID NO: 37259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattaacatgacacagcttggacacgaatg

SEQ ID NO: 37260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattacgaggccccgcttccaccatcccaa

SEQ ID NO: 37261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattacgcttaggtttcccggcccacccat

SEQ ID NO: 37262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattagagtcctttatcgactaggctaagg

SEQ ID NO: 37263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattatatccatcgttctctggtacggttg

SEQ ID NO: 37264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattattccatttaggataaagttggcaat

SEQ ID NO: 37265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattcacgtcgttccgatacccggccaatc

SEQ ID NO: 37266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattcagaactttcattgtcttgcgccgct

SEQ ID NO: 37267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattcccatgagctggaaggcgtcagtggt

SEQ ID NO: 37268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattccggccatgtaaatctgtggcaaggg

SEQ ID NO: 37269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattgacagaggctactttgcgtggccata

SEQ ID NO: 37270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattgataagaaccaggtcgcctcctgttg

SEQ ID NO: 37271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattgcaattaacgggtgtttttctttccc

SEQ ID NO: 37272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattgcacgctcataatgaatgtggccagc

SEQ ID NO: 37273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattgcctgttttgtcttctcaagtcctaa

SEQ ID NO: 37274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattgcgtaagttaaggtgggctgttatgc

SEQ ID NO: 37275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattgtacgccgcgccttaagaacctgatc

SEQ ID NO: 37276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacatttcgtatagactctatggtcatggtcg

SEQ ID NO: 37277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattttcatatgcgtccattgatcagggtt

SEQ ID NO: 37278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattttccaggtgtaagagtaagacgttcg

SEQ ID NO: 37279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacattttcggcacccggttagtactcgtctc

SEQ ID NO: 37280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaaacgattaagctccatcattcacggat

SEQ ID NO: 37281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaaacgcggtgacttcgccatggaggtag

SEQ ID NO: 37282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaaagactgtaccgaaggactgttagttc

SEQ ID NO: 37283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaaagccatcggcgtagcactgggaccgc

SEQ ID NO: 37284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaacaggactccctgggaaccggcttggc

SEQ ID NO: 37285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaacataacatgtattattttagcaggcg

SEQ ID NO: 37286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaacctagaacgtaatcttatactattgc

SEQ ID NO: 37287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaacgccacatgtacttggagttgtctca

SEQ ID NO: 37288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaagataagaaactccgcgcggctacgtg

SEQ ID NO: 37289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaagccggggcgcgtacgtggtcgggtgg

SEQ ID NO: 37290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaaggcatgacgttctgactgcgatgacg

SEQ ID NO: 37291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaaggcctatcgcatgcttgttcgattag

SEQ ID NO: 37292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaaggcctttagatcgtgaaatcccgctg

SEQ ID NO: 37293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaagggaggaggcccttagtgctgctgcg

SEQ ID NO: 37294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaagggtgtgtcattcagcaaccgccact

SEQ ID NO: 37295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaagtgtcgggaaggccctgaagaggctg

SEQ ID NO: 37296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaagttcgttacctacaggttcctctcgg

SEQ ID NO: 37297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaatacgacgctagaaatgcatacgatta

SEQ ID NO: 37298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaatgattgcaaggtactgtgctttaggg

SEQ ID NO: 37299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaatggtatgctcggccgctaagcctgta

SEQ ID NO: 37300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccacaaaagagttgtggaggtggactggca

SEQ ID NO: 37301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccacaggaagtctgttctcgtacgcgtatc

SEQ ID NO: 37302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccacatcctcggttactcgttcgacaggcg

SEQ ID NO: 37303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaccaacaacgtttttggaccgtagtttt

SEQ ID NO: 37304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaccaacgattacgcggccgatttgctgc

SEQ ID NO: 37305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccacccgccacatttaggtgttcccccgac

SEQ ID NO: 37306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaccctttgttactggcttcagctctgcg

SEQ ID NO: 37307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaccgtctcgaggggcggattaagagtgc

SEQ ID NO: 37308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccacgcaaaagggtatgcctcgggcgccgg

SEQ ID NO: 37309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccacgcacggaaggatccgacctcaaactg

SEQ ID NO: 37310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccacgcggcgccgggcttcaccctttcatc

SEQ ID NO: 37311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccacgcgttcattggacgacttaccgagcg

SEQ ID NO: 37312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccacggagtaaatggcgttgtatccggcgc

SEQ ID NO: 37313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccacgggcaatcagttgtaattgaactcat

SEQ ID NO: 37314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccactacaccgtaaccggggctacgtttcg

SEQ ID NO: 37315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccactacgacaagctctaaaggcgagtagg

SEQ ID NO: 37316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccactaggtgcgaataagctaagaaggcaa

SEQ ID NO: 37317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccactctgaacaccttctcgccgtaatttg

SEQ ID NO: 37318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccagacaacattacagaccaacttctggat

SEQ ID NO: 37319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccagacggtgagtagtcatgggtttgggtg

SEQ ID NO: 37320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccagaggaggttcggcgcatagttcgtgct

SEQ ID NO: 37321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccagatcagcgctgcatggatcggtgagag

SEQ ID NO: 37322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccagcactatttgccgtcagcccttcctct

SEQ ID NO: 37323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccagcagattgtacacgagctctgactggc

SEQ ID NO: 37324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccagccgtgatgtcatgccagtcgtaacgc

SEQ ID NO: 37325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccagcgagcggtttattatacagtcgtgtt

SEQ ID NO: 37326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccagcgagggtgtgagtgatacagcagctg

SEQ ID NO: 37327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccagcggagtatttgcaacatcggaagtcg

SEQ ID NO: 37328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccagcggataggactcaacccttggcgttt

SEQ ID NO: 37329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccagcttaatatagttaccgcacccccatg

SEQ ID NO: 37330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaggaaatggcggcctaacccttttgttg

SEQ ID NO: 37331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaggagctttttcttgttccattccggtg

SEQ ID NO: 37332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaggaggaatagcacttcgaattgcggcg

SEQ ID NO: 37333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaggagtgggtgactctcaatccggctag

SEQ ID NO: 37334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaggatgtctcgcagctgaactgctcccc

SEQ ID NO: 37335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaggcaccgcgcgggagtaacctttttga

SEQ ID NO: 37336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaggtcgccgtgacatggggttaggggtg

SEQ ID NO: 37337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaggtgacacccaattgtaggttattacg

SEQ ID NO: 37338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaggtggcgagagtgtgctcatcgctgct

SEQ ID NO: 37339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccaggtttcggatgggtgtgctttcccttg

SEQ ID NO: 37340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccagtagaagcgactagggatggtcggact

SEQ ID NO: 37341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccataccgatactatgccttcttccgtaca

SEQ ID NO: 37342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccataggttaacgcgttgttgttgcgttga

SEQ ID NO: 37343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccatatgtctggtttttcacgacgtgagtt

SEQ ID NO: 37344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccatccgacttacaaggggcgggactgaga

SEQ ID NO: 37345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccatccgattacgttaggccgcctgaatgt

SEQ ID NO: 37346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccatcgtcgagactggttcgtcgtcgggct

SEQ ID NO: 37347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccatgatccgtagggggattgtacagcact

SEQ ID NO: 37348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccatgcggatactacagagtctggtagttt

SEQ ID NO: 37349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccatggcagacctgagctggtgctataact

SEQ ID NO: 37350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccatggcgtatgtgatatccaccggtgtcc

SEQ ID NO: 37351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccatgggcacgaatacttcccgctggcttc

SEQ ID NO: 37352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccatgtaacggtctccgtgcgaatatcctg

SEQ ID NO: 37353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccatgtacgcaactcgtacaccccggaacg

SEQ ID NO: 37354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccattaatgcgggctatggatatatggcca

SEQ ID NO: 37355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccattatggtttgactgcgatgggcagtgt

SEQ ID NO: 37356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccattcaagtcgtgggtatcagcgattgtc

SEQ ID NO: 37357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccatttgttgagcctcgtgcataggttatc

SEQ ID NO: 37358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccaaacatttgaccggaaatcctgacttg

SEQ ID NO: 37359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccaaaggcacagttagaggtagacccggt

SEQ ID NO: 37360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccaagtcgaggtgccacatagtgtcacga

SEQ ID NO: 37361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccaccatactgtgtttgagcatccatttt

SEQ ID NO: 37362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccagaaggtgaggctagtaacgtgcactc

SEQ ID NO: 37363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccagaccgctgcttgaccgtgccaggttg

SEQ ID NO: 37364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccagattgccggaattcctggcccgctgg

SEQ ID NO: 37365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccagcaacggatgtcttcatgcgcccaat

SEQ ID NO: 37366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccaggaactcttctcatcttggacggatt

SEQ ID NO: 37367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccaggacggggctttctcaacactaacga

SEQ ID NO: 37368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccaggcgcaaggtcaacacatcagagggc

SEQ ID NO: 37369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccagtgggaagccaacattattcgccatc

SEQ ID NO: 37370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccagttacccttggacaactgtacccatc

SEQ ID NO: 37371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccataacgaagcacccaacgcggttgtgc

SEQ ID NO: 37372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccatacaaagatgcgggctgagtattttg

SEQ ID NO: 37373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccatatactgtgatcggcgcacggttctg

SEQ ID NO: 37374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccattaagccgcctctccggacttctaga

SEQ ID NO: 37375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccattttattgtttggtaggatgattaag

SEQ ID NO: 37376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccccacacaggatggcgacgaatactcgcg

SEQ ID NO: 37377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccccacgagcgctagaaactggatagtccg

SEQ ID NO: 37378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccccagcatccatagtccagtaccgtgtgt

SEQ ID NO: 37379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccccatgtcagcgtcagtataggcaatcg

SEQ ID NO: 37380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccccgtaatttgcgttccgatcgccctta

SEQ ID NO: 37381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccccctctcagtcgttataatgcagggttc

SEQ ID NO: 37382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccccgcgcttgtgaagccccagattggtcg

SEQ ID NO: 37383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccccggctaagcgcatattggccaggtctc

SEQ ID NO: 37384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccccggtcctcaccgaacgccgtgcagtgc

SEQ ID NO: 37385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccccgtaaccaagccctctgctgcacgatc

SEQ ID NO: 37386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccctcgccgcaaactgtaagcgggtgctg

SEQ ID NO: 37387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccccttgatcattttcctgttattggctag

SEQ ID NO: 37388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgaatccggcgttgtggtctggacttta

SEQ ID NO: 37389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgaccaataagggcctgcctgatcggac

SEQ ID NO: 37390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgacgctatcgtagtctgtgccaggggc

SEQ ID NO: 37391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgagcgccgataccctgactcctggcta

SEQ ID NO: 37392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgccacgaggagatgagtaccattaccc

SEQ ID NO: 37393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgcccgtcgcagataatccttcgcggtt

SEQ ID NO: 37394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgcgaaagcccatagaacacctttgctc

SEQ ID NO: 37395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgcgacccctcgcttgctactgcggtca

SEQ ID NO: 37396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgcgattgtggtgacaattgtgacaacg

SEQ ID NO: 37397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgctacgtgcgccaccgtaaggatccgc

SEQ ID NO: 37398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgctatagggctacgtgtttgtgattac

SEQ ID NO: 37399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgctcgtgtgtacccgactcgccacgcg

SEQ ID NO: 37400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgcttggattcaaagttatttttgaccc

SEQ ID NO: 37401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccggcaatgtgaatccgcgaggcgaaggt

SEQ ID NO: 37402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccggccgaatttgttgtcgttttctgacg

SEQ ID NO: 37403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccggccgcttgtgttatgtcgggtattac

SEQ ID NO: 37404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccggcgacagttgaatgtctttgctagct

SEQ ID NO: 37405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccggctatctcggcttgttcttcagtctt

SEQ ID NO: 37406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccggcttcttcctccggctcggagatctg

SEQ ID NO: 37407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgggcgtgcacacaacgacaacttcatc

SEQ ID NO: 37408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgggctttgttaccgatgtgctttcccg

SEQ ID NO: 37409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccggtagttatccacgttgcagctggact

SEQ ID NO: 37410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgtactgatttactggcttttactttat

SEQ ID NO: 37411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgtccaggtttgtactgcgctgcgccat

SEQ ID NO: 37412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgtccatcgggagtgcgtaccactagcg

SEQ ID NO: 37413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgtcgattccgttatggcacgccctcat

SEQ ID NO: 37414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgtgcccattcgctttgcactagttcgg

SEQ ID NO: 37415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgttaacggaattacggacgtgggcggt

SEQ ID NO: 37416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccgttcgatttatgcaacgcgcccgctgg

SEQ ID NO: 37417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccctcccgcattcgtgtcatggtgtccttc

SEQ ID NO: 37418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccctccctccgcatgattggtcgttggaat

SEQ ID NO: 37419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccctcgttcatggcagacgtgacagctacg

SEQ ID NO: 37420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccctgcaggatgcactccattcaccgcttc

SEQ ID NO: 37421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccctgctatgactcgtccttggtatatacc

SEQ ID NO: 37422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccctgtatgcgtgttgtttcattcgtagtc

SEQ ID NO: 37423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccttactccccagctcggaatcgccaggc

SEQ ID NO: 37424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccttaggtggttaaaagggtggaacgtgc

SEQ ID NO: 37425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccttgaccccgggtagcgatgtttatcct

SEQ ID NO: 37426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacccttgagtacggtttcataactcgcttct

SEQ ID NO: 37427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgaaagacccgccgatcgcaagtcacccc

SEQ ID NO: 37428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgaaataatgtggtatattccacgaggtg

SEQ ID NO: 37429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgaacctgtgctatagtcgcccttgctta

SEQ ID NO: 37430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgaagacgcggaaatctactcccaaacct

SEQ ID NO: 37431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgaagcgcaaagtatgactgtagactctc

SEQ ID NO: 37432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgaagcgggtcctaactgcatggggtggc

SEQ ID NO: 37433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgaaggctccacgaagcacaccaccttat

SEQ ID NO: 37434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgaataccggagaagtttgttgtggtcgg

SEQ ID NO: 37435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgacctggataaggataaaaggaggctgc

SEQ ID NO: 37436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgacgacctaatgttccgagacaccgtat

SEQ ID NO: 37437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgacggaacgtgccccagtggaaaccatg

SEQ ID NO: 37438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgactcgatcagtaatcaatcgatcgatc

SEQ ID NO: 37439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgagagcgcaagacagccgagtgcgcttt

SEQ ID NO: 37440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgagcataactttgacctcgttacgtaat

SEQ ID NO: 37441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgagcgttctccattgcacccctaacttt

SEQ ID NO: 37442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgagctcctgtgtcaagtaggccccgcgt

SEQ ID NO: 37443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgaggggtgccactgacgtagtcgctgtc

SEQ ID NO: 37444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgataggggacgtacatgtaccgctcgaa

SEQ ID NO: 37445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgatcgcgagccccatcagaccgttggcg

SEQ ID NO: 37446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgatcgggcgctcatattgcctcttgcgt

SEQ ID NO: 37447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgatgcctttacgacgtagggcaactcgg

SEQ ID NO: 37448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgattgacggagcggaggtgacccaatac

SEQ ID NO: 37449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcaaagtcaataaagacttcagcacgaa

SEQ ID NO: 37450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcaccccgggcccgcgaatgcttgggtc

SEQ ID NO: 37451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcacgcacaagaacggagcctgatggag

SEQ ID NO: 37452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcaggcccgtgggtggttgcgttgtcca

SEQ ID NO: 37453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcagggagcgcacactggatttgtgccg

SEQ ID NO: 37454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcaggttgggttaagagggtttaggtcg

SEQ ID NO: 37455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcagtcagttccccgagtctcagccgaa

SEQ ID NO: 37456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcagtgaccacccggacgacctgatgtc

SEQ ID NO: 37457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcatcacagcacccaacagcggtacgat

SEQ ID NO: 37458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcatggcagaaggatccatatctagtca

SEQ ID NO: 37459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcatttccggttattcgacccatggtaa

SEQ ID NO: 37460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgccacacaatggatactcccgactcgag

SEQ ID NO: 37461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgccaccagcttttatctaccagccggca

SEQ ID NO: 37462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgccagcaggggagacggcgtgtcacaag

SEQ ID NO: 37463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgccatcagtctccgggtgccattcatgt

SEQ ID NO: 37464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgccccctccttgcccgaggcgggagcac

SEQ ID NO: 37465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgccccttgtctaaccgacttgggtcgca

SEQ ID NO: 37466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgccggatccggagtgctaactgcttcgc

SEQ ID NO: 37467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgccggggagctcgtcctcgatgagaggc

SEQ ID NO: 37468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgccgtgtaggagccaaggcctgaagctc

SEQ ID NO: 37469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcctcctgcgcaagtatcgtgttccggt

SEQ ID NO: 37470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcctggtgaaataatgacttctaggtat

SEQ ID NO: 37471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcgaacagcccttgcccgacgctgccca

SEQ ID NO: 37472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcgaacgatcatcaacgtcgatgcgggc

SEQ ID NO: 37473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcgaactttcctgttatggtatctggcc

SEQ ID NO: 37474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcgagacagctttagaatgcgagatgat

SEQ ID NO: 37475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcggaggtctaaagccgtggtggatgcc

SEQ ID NO: 37476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcgtgcaatggtcaagtcggagcttgcg

SEQ ID NO: 37477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgctcaacaggctcgtgagcacctgcgga

SEQ ID NO: 37478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgctccaaacgggacttgttgtgcccgaa

SEQ ID NO: 37479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgctggtcaagtttttcagatcttttcac

SEQ ID NO: 37480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcttctggggtcatgcagagcgtaggcg

SEQ ID NO: 37481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgcttgggtgtctcgccagggtgggtgct

SEQ ID NO: 37482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgctttctctgtgtgctgttttcgtcctg

SEQ ID NO: 37483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggaaccgtggtcattggggccgtttgag

SEQ ID NO: 37484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggaaggatggttgaggacttgggcgggg

SEQ ID NO: 37485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggaatgccgtgagggccgctatgctcgt

SEQ ID NO: 37486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggacaaacgttaagcctggtgaaggaga

SEQ ID NO: 37487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggacttgcatgcctactgaataagaggc

SEQ ID NO: 37488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggagcctggttagtggctgtcaaggtca

SEQ ID NO: 37489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggagggcttcagcactgacctgggccgc

SEQ ID NO: 37490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggatatggcttggtcctggactgatgcg

SEQ ID NO: 37491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggatccctcaggctcagcaccggcggtc

SEQ ID NO: 37492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggatccgccagtctttagcaccaggctg

SEQ ID NO: 37493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggatgggcttaatcgaagcacactgtcg

SEQ ID NO: 37494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggattgacatgtttgggggtcaatggtc

SEQ ID NO: 37495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggcacatgatcggggcatcgggcattag

SEQ ID NO: 37496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggcactccacacctctgctctgttcagc

SEQ ID NO: 37497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggcacttatgagcgcgtgcagcgggcgg

SEQ ID NO: 37498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggcagggcttgtcgactatgtatcgggg

SEQ ID NO: 37499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggcagtccaggaagccactaaacgtgtt

SEQ ID NO: 37500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggcatatttgagcggacacgagctggga

SEQ ID NO: 37501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggcattccgatggatagggtaggtatag

SEQ ID NO: 37502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggccttctctggctaagacgcaccagga

SEQ ID NO: 37503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggcgcacgatgatgacgaggtctccttc

SEQ ID NO: 37504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggcgcatgaccgcggcggctggagcgat

SEQ ID NO: 37505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggcgcctcacgtagaatcgattgccagc

SEQ ID NO: 37506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggcgggagtgcacaatccaggtcgcagc

SEQ ID NO: 37507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggctgtggacgtgcgaccttgtggattt

SEQ ID NO: 37508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgggatcgcatggattgaattccccgtac

SEQ ID NO: 37509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgggatcgtggtataatggcccaacattc

SEQ ID NO: 37510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgggcatgagacgttacattctggtgagt

SEQ ID NO: 37511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggggagcgatggtcactcttggatgtga

SEQ ID NO: 37512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggggtcacaatgggttcggcaggtgact

SEQ ID NO: 37513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgggtatcttgttacaacgttgcggtttg

SEQ ID NO: 37514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgggttagttaagcggagcttggtgtccg

SEQ ID NO: 37515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgggttccctagatcgccgtgaccaccgc

SEQ ID NO: 37516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgggttggcccttgggcacttttgggatt

SEQ ID NO: 37517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggtagcacgctcaatgtgtttaagcgta

SEQ ID NO: 37518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggtctcattctagaatagccgcgcgtta

SEQ ID NO: 37519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggtcttctgcacgcaactttttatccgt

SEQ ID NO: 37520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggtgagcacactaggtagatcatgccct

SEQ ID NO: 37521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggtggcatcgtggtagcctcattctgcg

SEQ ID NO: 37522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggttatgagggggcctttcagattacgt

SEQ ID NO: 37523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggttcaactgcgatgactgcccaggacg

SEQ ID NO: 37524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccggttgctcaccgattggtagtctgggta

SEQ ID NO: 37525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtaaaacgcttggcgggccacggcttgg

SEQ ID NO: 37526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtacccaaggcttcagtgtactcgctcg

SEQ ID NO: 37527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtactgcgtcaagggtcttggttcagtt

SEQ ID NO: 37528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtagcttctttcagaaggcctgctcgtg

SEQ ID NO: 37529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtagtcttcctgtaacctgccttttggg

SEQ ID NO: 37530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtatgtagcaacttgagttaacctgggt

SEQ ID NO: 37531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtcaactgtcaatgttgtcccaagttat

SEQ ID NO: 37532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtcacgtttcggcagatcatggtgcggt

SEQ ID NO: 37533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtcatgtcaccaaatgtcctacgtggcc

SEQ ID NO: 37534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtcgctgagcgtctactgatacctcttc

SEQ ID NO: 37535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtcgggagagcatagcgggagtaggagt

SEQ ID NO: 37536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtctaacgtttctctcctacgcggtcat

SEQ ID NO: 37537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtctatccgtattcacagacagtaatga

SEQ ID NO: 37538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtctcgtggtcgtgcttttgcaggtgtc

SEQ ID NO: 37539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtctcttgagtaacatcaggattctcac

SEQ ID NO: 37540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtgaccgttgcgttcatgccctgatcga

SEQ ID NO: 37541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtgatagaaattgtgctgaccggcgtcg

SEQ ID NO: 37542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtgcacaaacccaacaatataagacagt

SEQ ID NO: 37543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtgcacttaactaactacctgcaatcgt

SEQ ID NO: 37544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtgcctttggatgctgtgtggagttctt

SEQ ID NO: 37545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtgctacgcctccgttatctcgtcattg

SEQ ID NO: 37546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtgctagcagcgtctcgaggttgtgtgc

SEQ ID NO: 37547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtggcctattgattttgaatacgcattg

SEQ ID NO: 37548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtggcgtaggtcggcgcttgggtccgtc

SEQ ID NO: 37549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtgtataggcggatgtttgcacggtagg

SEQ ID NO: 37550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtgtcagctgttaactgattgctttctt

SEQ ID NO: 37551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtgtgagacctccctaccgtttgtgcgg

SEQ ID NO: 37552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtgtgcagcagttggaatcgtgacatag

SEQ ID NO: 37553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtgttccgtgtgggtgtatcggttacca

SEQ ID NO: 37554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgttcaaaataggcctcttctttgggcaa

SEQ ID NO: 37555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgttcgggtttatagcgattttcggattt

SEQ ID NO: 37556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgttggattaaggacgccacccgtttatt

SEQ ID NO: 37557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtttactcacgggaattgcgtaccccac

SEQ ID NO: 37558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccgtttccacatgatcaaagccgtccttcc

SEQ ID NO: 37559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctaagctttcgatgtcatgtcatctgatg

SEQ ID NO: 37560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctaagtcatgcctctctcagtttggcgag

SEQ ID NO: 37561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctaatcgatgcacattataaattactctc

SEQ ID NO: 37562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctacacagtgatgggcagaacgacattgg

SEQ ID NO: 37563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctacacgctagcgagcggcattcttgagg

SEQ ID NO: 37564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctaccgtgtcgttccacatgcgcctccgg

SEQ ID NO: 37565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctacctatgaatgttaaagtttgagggcg

SEQ ID NO: 37566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctacgaacatcgacgacgttctactctcg

SEQ ID NO: 37567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctagaacatgcaaacattacatggcgtgg

SEQ ID NO: 37568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctaggagactaaccacggaggcgagggag

SEQ ID NO: 37569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctatcattaccatggctttttgttccctg

SEQ ID NO: 37570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctatgttagctcagccggacactgcgttg

SEQ ID NO: 37571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctcacccggactccgattcttcaagtgta

SEQ ID NO: 37572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctcactcttactaggcttccgtatatgct

SEQ ID NO: 37573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctcagggaatcgaagcacgtgcggggaca

SEQ ID NO: 37574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctcatcaccgtgaatctctcgttcacaat

SEQ ID NO: 37575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctcatcccaccttgacacctccaggtgcg

SEQ ID NO: 37576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctccatccgacggagagaaattacgtgga

SEQ ID NO: 37577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctcccgccatacgcgacgccctgtagccc

SEQ ID NO: 37578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctccgccactgcaccgatgatccagtgtc

SEQ ID NO: 37579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctccgggtactaaggctacatgggggttc

SEQ ID NO: 37580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctcgagtgcagctccgaccatttgagctt

SEQ ID NO: 37581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctcgcgctctgacttacacgctctagacg

SEQ ID NO: 37582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctcgcggaatttcgattactcgcgccctg

SEQ ID NO: 37583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctcgctacatagtaagctgtacgtgttag

SEQ ID NO: 37584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctcgcttccgaaaatgagaatcaatggct

SEQ ID NO: 37585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctcggcttacgctgagctcacgtaaagta

SEQ ID NO: 37586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctcgttaagggacacgaatgtgaacaacg

SEQ ID NO: 37587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctctagctaccacctgttcgcgccgtgcc

SEQ ID NO: 37588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctcttcgagatggtgggcagtattcaact

SEQ ID NO: 37589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctcttgcagagcggtacgggttcggcagt

SEQ ID NO: 37590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctgacacaaacggagcgggagatcgagac

SEQ ID NO: 37591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctgacacgctgtgcacttcaatacgacgt

SEQ ID NO: 37592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctgaccgcgctcgaattacttttggttta

SEQ ID NO: 37593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctgatagcggctcgaagtgccacggggac

SEQ ID NO: 37594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctgattgtccatggcaaggcatctcatcc

SEQ ID NO: 37595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctgcatagattgccattgtcggtcagtta

SEQ ID NO: 37596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctgccgaacgattctctgctcgtgggcaa

SEQ ID NO: 37597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctgcctgcgggcggaagggttctacttcg

SEQ ID NO: 37598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctgcgagcaataccccgtactcagctagt

SEQ ID NO: 37599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctgcggacagtctctcttcctctttgtcc

SEQ ID NO: 37600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctgctatcactgactcccgacggcagagc

SEQ ID NO: 37601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctggccaatatctgggtcttaatggggac

SEQ ID NO: 37602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctggcgacttcccaccgtgggcttagatt

SEQ ID NO: 37603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctggcggcgcgatcaaatgtggcatgtcc

SEQ ID NO: 37604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctggcgtctagaagttctgatgttcctgg

SEQ ID NO: 37605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctgggaaatggatgtcatggtgcgacggc

SEQ ID NO: 37606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctgggtagacgcacggggatggttacacg

SEQ ID NO: 37607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctgggtgccgtacaattgttatctatttg

SEQ ID NO: 37608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctggtctcggcgctggattattgcgttgg

SEQ ID NO: 37609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctgtaacgcacacgcagagcgttacctct

SEQ ID NO: 37610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctgtcgaattatttggacggcatacgaac

SEQ ID NO: 37611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctgtctacttcttttagggctaatagagg

SEQ ID NO: 37612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctgttcacctttcttgcggcaatagacta

SEQ ID NO: 37613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccttaatctggcgtcggccacaggtagtgt

SEQ ID NO: 37614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccttaccacttcatcgtacaccgtgctctt

SEQ ID NO: 37615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccttatacaccaggttgtttggttgcccac

SEQ ID NO: 37616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccttcaattcattccagttaggtttcccat

SEQ ID NO: 37617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccttcagcagctacgatacggctcactacg

SEQ ID NO: 37618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccttccatcagctcgccggttcgggtcgtt

SEQ ID NO: 37619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccttgactaaatctgtgcaaatgatttgac

SEQ ID NO: 37620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccttgattgtttgtggaagatggcgtgtgg

SEQ ID NO: 37621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccttgcagagagtcactagcacctccgttc

SEQ ID NO: 37622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccttgcttcgtggttcgatctttcgaatgc

SEQ ID NO: 37623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccttggcggccttgctagagggttaggcga

SEQ ID NO: 37624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccttgggtgtgggagtccgacgggggtccg

SEQ ID NO: 37625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccttggtggatacggggaatgcgaggtcta

SEQ ID NO: 37626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacctttatacagaggctactccatccacatc

SEQ ID NO: 37627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaccttttctcgacgcctaccgtgcccgggcc

SEQ ID NO: 37628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaaacggcgttttacagggttaaaagctc

SEQ ID NO: 37629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaaactagacaataccgactggtgcccta

SEQ ID NO: 37630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaaagccatagccgggcccaacccagtta

SEQ ID NO: 37631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaacaggcaacggcccgagatacctcggt

SEQ ID NO: 37632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaaccccggtaaaccttggaacgcgtgta

SEQ ID NO: 37633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaacccggccccttccgattggagcagtg

SEQ ID NO: 37634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaaccttttacgcacgtgattggcagtcc

SEQ ID NO: 37635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaacgaaagcagaataacgggctgagcgc

SEQ ID NO: 37636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaacgagcggagggctctggcgctgggac

SEQ ID NO: 37637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaacttatatcagtcggctaaggtccctc

SEQ ID NO: 37638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaacttgtaaccttcgctcattactctcg

SEQ ID NO: 37639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaagcgtggctgaaggctcttgcctggat

SEQ ID NO: 37640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaaggcattcaggccttattgcggtccgt

SEQ ID NO: 37641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaaggccactcgttgagcgtgagacgagg

SEQ ID NO: 37642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaaggcgtcaagctatctaaccgagcata

SEQ ID NO: 37643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaaggtgcacattatagcaatgagccgat

SEQ ID NO: 37644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaagtcataggaacgggacaaggcgggcg

SEQ ID NO: 37645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaagtgccacgtgtattgtcatttgctac

SEQ ID NO: 37646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaagtgccggagctagggcgcatgcctcg

SEQ ID NO: 37647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaatcagtcacacagtaaccatttggtca

SEQ ID NO: 37648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaatccaaagtatgaaagcacgttttccc

SEQ ID NO: 37649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaatcgtcgtgaacgaggtcgcttctcgg

SEQ ID NO: 37650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaatctcgcttgtttttcgctgtttcgga

SEQ ID NO: 37651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaatgaagggtcacgctcccataggcttg

SEQ ID NO: 37652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaatgggcatagttacgtaaagggatcta

SEQ ID NO: 37653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaatttcgcaatcaggttatgttcgcgcg

SEQ ID NO: 37654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaatttctatttaatccacgattggtgcg

SEQ ID NO: 37655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacaaatctgccgttaggaaggtaggtgg

SEQ ID NO: 37656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacaatacgcctctcgcagattcgggttc

SEQ ID NO: 37657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacaatagctgacgggataccgctgcgga

SEQ ID NO: 37658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacacgtagcgtttgacagggttatgcca

SEQ ID NO: 37659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacagcactgacgactaacacagcgtata

SEQ ID NO: 37660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacagttggaggtaaggcgatgatttcgc

SEQ ID NO: 37661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacatcatcaaacattagcccgtccaggg

SEQ ID NO: 37662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacattatgcggtgcacaagtgaccctct

SEQ ID NO: 37663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaccacccgagccgtggaacgtctgcgcc

SEQ ID NO: 37664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacccaagaatgtattcaccacgttagcc

SEQ ID NO: 37665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacccgccgcaactttccgggtgaataga

SEQ ID NO: 37666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaccgatatcgacctctattttgacggca

SEQ ID NO: 37667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacctcagtaaaccaaggattcttactta

SEQ ID NO: 37668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacctgtatgcgatttggacattgacatc

SEQ ID NO: 37669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaccttctttattatctcccttgtctgcc

SEQ ID NO: 37670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacgacctcttaccccttgccacgtcgct

SEQ ID NO: 37671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacgcaactaacgaggaaattgcgacatg

SEQ ID NO: 37672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacgcaggcattgtgcgactccaaagaga

SEQ ID NO: 37673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacgccttgtatggggattaggcatctag

SEQ ID NO: 37674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacggcacgccccttgtttccttaaatga

SEQ ID NO: 37675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacgttgggcgtgattggcccgtgctgct

SEQ ID NO: 37676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgactaacgaccgcgcgacctttgatgttc

SEQ ID NO: 37677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgactaccattttgcgaacgatctgccttt

SEQ ID NO: 37678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgactatcatctagccctggaatttactgg

SEQ ID NO: 37679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgactctccgggttcggacaagcacgtgtg

SEQ ID NO: 37680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgactgacagcattgcccaaagtaccgccg

SEQ ID NO: 37681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgactgagccacctcgcctggactagggac

SEQ ID NO: 37682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacttactcagtctcaggcaatacatcaa

SEQ ID NO: 37683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacttgctttccacgtaacggtcacgctc

SEQ ID NO: 37684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgacttggtgaattgtcctgcaccttattt

SEQ ID NO: 37685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgagaccgggaaaccctttttagcactggc

SEQ ID NO: 37686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgagaccgtcggcggtgcccatgtaatccg

SEQ ID NO: 37687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgagacgggcgcattgagctgtctcggtgc

SEQ ID NO: 37688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgagactttttgcagacggccttatccgca

SEQ ID NO: 37689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgagagtagcgaaggtatggccatctcccg

SEQ ID NO: 37690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgagcacttccgatcagtaaagccgcgccg

SEQ ID NO: 37691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgagcagggacagtttcacatgggcggcct

SEQ ID NO: 37692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgagcatccgcttgaggatagtcttcgcga

SEQ ID NO: 37693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgagcatgtcaccatgtacactaggatcca

SEQ ID NO: 37694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgagccatgcatcacggaattccggagcct

SEQ ID NO: 37695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgagccggtcacgagttgaattcacgtggt

SEQ ID NO: 37696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgagcggtgccatctgtttttggtttttat

SEQ ID NO: 37697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgagctcgagaagactctcatgcagtctga

SEQ ID NO: 37698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgagctgacaaggcggagacggcatcccct

SEQ ID NO: 37699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaggaaacaggagccggtcgttggaggtt

SEQ ID NO: 37700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaggaaactgaagcacactacgccattag

SEQ ID NO: 37701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaggaagttggcctgcaagtgtcatgtgt

SEQ ID NO: 37702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaggcatccgcgtgcttggtttaatgtgt

SEQ ID NO: 37703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaggcccaaccgcatctttgcacacactt

SEQ ID NO: 37704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgaggtgggtgggaatgccgtgctcctggc

SEQ ID NO: 37705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgagtagctgtggtggtttatgcccctccg

SEQ ID NO: 37706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgagtcaccggagcagtcgcctctagtccg

SEQ ID NO: 37707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgagtggggtaccgatagtgcagagcggga

SEQ ID NO: 37708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgagttcgggctctaacctgcaaatgctgc

SEQ ID NO: 37709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgatacttgtccaagaaagttatatcctgc

SEQ ID NO: 37710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgatcacaccgcagcgccaagggctcggac

SEQ ID NO: 37711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgatcagcgggatgcgttagtaaaagggtt

SEQ ID NO: 37712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgatccatcgactgcgaatgcccgtgagct

SEQ ID NO: 37713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgatccccatgggaccaccgggctcggggc

SEQ ID NO: 37714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgatcgacaggcacaactcggctgccattc

SEQ ID NO: 37715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgatcgcaggacatcaagacgataaaggga

SEQ ID NO: 37716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgatcgctagatcagatccggtgttcgcct

SEQ ID NO: 37717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgatcggttcctgctgggacgaatcttgtt

SEQ ID NO: 37718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgatcgtccgtcctagcgtacgcggcctcg

SEQ ID NO: 37719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgatctcgattcagctatccatggagggtg

SEQ ID NO: 37720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgatcttttgggtcttgttcccggttccgt

SEQ ID NO: 37721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgatgacgacatgaactctagtgctcgatt

SEQ ID NO: 37722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgatgacgttccgtacgtagcacctcccgg

SEQ ID NO: 37723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgatgcaagacgtgtggtggggtctgggag

SEQ ID NO: 37724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgattaaggtgaggaagacgcccgatttga

SEQ ID NO: 37725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgattcctccatacgtagtatcatcgtttc

SEQ ID NO: 37726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgattgaacggtgtaaatcacgaacctggg

SEQ ID NO: 37727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgattggacacgtgcgtgcactgatacgct

SEQ ID NO: 37728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgatttaaaagccattttgctgcggattaa

SEQ ID NO: 37729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgatttaccagcccggtacatttactcttc

SEQ ID NO: 37730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcaaacaggaatccagaattccgtcaact

SEQ ID NO: 37731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcaaagtcggcacgttacgttgtccgggc

SEQ ID NO: 37732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcaacacgacgtaaggtcaacggacttag

SEQ ID NO: 37733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcaaccgttagattcatgctcatgctcgg

SEQ ID NO: 37734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcaagaaaagtattaactgtatcgaggtc

SEQ ID NO: 37735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcaagtacggtcgatcgcctcgtctttgt

SEQ ID NO: 37736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcaagtttcgcaaaggttggtttgccacc

SEQ ID NO: 37737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcaatcggtcttaatgtgcgttgttcagt

SEQ ID NO: 37738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcacaaccgtgtccatgcctgtctatatg

SEQ ID NO: 37739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcacagcaatggttgttgcttcatcggtg

SEQ ID NO: 37740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcacagtcattgcggtggcatatgtcgaa

SEQ ID NO: 37741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcaccagtatgatcataaggccgccggta

SEQ ID NO: 37742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcacgggcttacctttgaatactatgccc

SEQ ID NO: 37743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcacggggctctggattctgctatttccg

SEQ ID NO: 37744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcacgtagcggagtttctggccaatgttg

SEQ ID NO: 37745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcacgttacgaccccttctgtggctcaag

SEQ ID NO: 37746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcactactcccggatccgcggttcaaact

SEQ ID NO: 37747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcagaaacggaggaccaatagcggcggag

SEQ ID NO: 37748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcagacagcggggtatactcatggttact

SEQ ID NO: 37749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcagctgtaatcaacaagggcttaattcg

SEQ ID NO: 37750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcaggactattatttataacccgtgttca

SEQ ID NO: 37751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcaggagtatagagggtttaccttgtcca

SEQ ID NO: 37752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcaggcgctgtatccaccgacatcaatca

SEQ ID NO: 37753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcagggcacgaataatgcacacgctgcaa

SEQ ID NO: 37754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcagggcagcatcggagcacacacgcttg

SEQ ID NO: 37755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcagttcagcggcagtcgtgggctctatt

SEQ ID NO: 37756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcatataacctccaggcggtaagttttcg

SEQ ID NO: 37757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcatccgcacggctgatttgccctggttc

SEQ ID NO: 37758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcatcgagtggataactgtggggctgggc

SEQ ID NO: 37759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcatgaccaagaaaacccgattcaggttg

SEQ ID NO: 37760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcatgagtaggaaattgtattgattttta

SEQ ID NO: 37761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcattggggcagagacggtatattcggtt

SEQ ID NO: 37762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgccaaaccgtagctttgcgatccccggga

SEQ ID NO: 37763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgccaaggcccgcgacgcgcagtctaaccc

SEQ ID NO: 37764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgccaataatcgccgagcggtaattccccc

SEQ ID NO: 37765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgccacttggggtatcgccaaggtcgtacg

SEQ ID NO: 37766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgccagcagaagtgggtctcctgcacgtag

SEQ ID NO: 37767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgccatggtggtaagccactgttgatatac

SEQ ID NO: 37768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcccaagtaatatgtggacacaactgagt

SEQ ID NO: 37769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcccacagcacttcgacgggaaagcaacg

SEQ ID NO: 37770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcccacgttttcttgatgcttatggggac

SEQ ID NO: 37771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcccagacaccccgtcctaatctattcga

SEQ ID NO: 37772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgccccgcgtgtgaagatcttgaactagca

SEQ ID NO: 37773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcccctagtacgcatcgcataataacgag

SEQ ID NO: 37774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgccgagtgtgtagcgcgcgttgtcgcccg

SEQ ID NO: 37775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgccgatgctgacatcagaaggtactgtct

SEQ ID NO: 37776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgccgcagtaacttcaatccaaaacggcca

SEQ ID NO: 37777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgccgcgaggcccaggaggaaatagcggtg

SEQ ID NO: 37778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgccgcgtttcaatggagggatggggggag

SEQ ID NO: 37779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgccgggtcgtccaacgcagcaggttgtca

SEQ ID NO: 37780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgccgtagaggccgggaagagcgatctgga

SEQ ID NO: 37781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcctactgccatattctacgtctcttgcg

SEQ ID NO: 37782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcctctatacactacttggacttgtcatc

SEQ ID NO: 37783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgaccgggcggttggcacgggcaaggtc

SEQ ID NO: 37784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgacgaacactgccgggttggcccttga

SEQ ID NO: 37785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgacgagattccggaaggtaacggcgtt

SEQ ID NO: 37786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgacgtaggataaacaggtactacgcta

SEQ ID NO: 37787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgactgaccgggcaagttcatttgctgc

SEQ ID NO: 37788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgagcatagtttgttacggttctgtggt

SEQ ID NO: 37789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgagcgcatcttttcatacgtcgtcggg

SEQ ID NO: 37790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgatgtgttccgtgtctactcaaatgag

SEQ ID NO: 37791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgcaacccgattttcacatgcacgacgg

SEQ ID NO: 37792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgcaacttattgccctggtaccaaggcg

SEQ ID NO: 37793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgcaccgtaaaccaggtccagcctctga

SEQ ID NO: 37794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgccgcagcttcaaagtgtgactctgca

SEQ ID NO: 37795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgccggtggccattatgcagcttgagac

SEQ ID NO: 37796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgcgacaagcagtaggggacggagggcg

SEQ ID NO: 37797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgcgacgtaggctgtcagcgggattcgg

SEQ ID NO: 37798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgcgcacctaaagttgacgttttgcttt

SEQ ID NO: 37799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgcggtctccacagaattgtcaggtgcg

SEQ ID NO: 37800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgcggtggtatcctgcattctgaggtag

SEQ ID NO: 37801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcggacaggtaccgatttctagactttcc

SEQ ID NO: 37802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcggagtacaggcacgagttcattgcacg

SEQ ID NO: 37803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcggcattgagctttcatgggcaaagcgg

SEQ ID NO: 37804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcggccaaaaatcgtctcgtggatttgtt

SEQ ID NO: 37805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcggccgagtctgacggagttgcagggtg

SEQ ID NO: 37806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcggcgatggatcagcgctctgggacctg

SEQ ID NO: 37807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcggctaagtgttgtttccttggatccgg

SEQ ID NO: 37808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgggaaactacaggctactccccttcca

SEQ ID NO: 37809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgggcgacatggggtcatcccgtagtaa

SEQ ID NO: 37810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgggggacgtgagcgagagtaaacatgc

SEQ ID NO: 37811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcggggttacggtgatggagttggcctgg

SEQ ID NO: 37812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgggtgcagcaggtgcgatatgacgggt

SEQ ID NO: 37813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgtagagacgtattcaccacttcgctta

SEQ ID NO: 37814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgtcaccgattcagccggatccgaccgc

SEQ ID NO: 37815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgtccagtgcttatccctgttgccgtgt

SEQ ID NO: 37816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgtccgatgggggcaggaacgacgatcc

SEQ ID NO: 37817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgtctctactttgctgctactattcatt

SEQ ID NO: 37818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgtcttaccttctctttgaatcgtcgtt

SEQ ID NO: 37819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgttcaataagtacgtcagggacgcagg

SEQ ID NO: 37820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcgttcggtatacacatgaagacccgtga

SEQ ID NO: 37821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctaaagtacatggcatggcatcgccaat

SEQ ID NO: 37822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctacacgggaattatgacccgacatctc

SEQ ID NO: 37823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctacggaagagcatcatcgttccacgtg

SEQ ID NO: 37824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctactaataccgctgcgagttggcgtat

SEQ ID NO: 37825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctagatccggtactgcatgttgggcccg

SEQ ID NO: 37826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctagcggggaagcgtggcagtaggacgt

SEQ ID NO: 37827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctaggaccggaactgctcttaccgttcc

SEQ ID NO: 37828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctcagaccttgtaagtcgcctcctgacg

SEQ ID NO: 37829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctccgtgcctctcagctatttactgact

SEQ ID NO: 37830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctcctttcctgtgtagatatgctactgc

SEQ ID NO: 37831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctcgatctggcacataggtggccatcgc

SEQ ID NO: 37832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctcgttttgcttggggaacaggcgtgct

SEQ ID NO: 37833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctgaaggctctggtttggatctctgcta

SEQ ID NO: 37834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctgagaggtcacgaccttgcttgtagcc

SEQ ID NO: 37835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctgggagttatttagctgttgcacagat

SEQ ID NO: 37836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctggtcctgttaaatagcgattgatgtg

SEQ ID NO: 37837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctgtcataaccttagccaagcgccacgc

SEQ ID NO: 37838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctgtgagagcactttcagttacacgcca

SEQ ID NO: 37839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctgtggcatgaagcggggagtcgacacg

SEQ ID NO: 37840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctgtgggtttcagtagaccgacgctgga

SEQ ID NO: 37841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctgtggttggcagctgtatgggagcgct

SEQ ID NO: 37842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcttacccgtgcgaacaattacgtgtcca

SEQ ID NO: 37843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcttgcggtgactctcgctctggtcggcg

SEQ ID NO: 37844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcttggggacgaaagcgcgtagttgttta

SEQ ID NO: 37845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctttacataggagactggtagggccgcg

SEQ ID NO: 37846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgctttctgaccttcccccgttctttcctt

SEQ ID NO: 37847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgcttttgcgggtgggtctaccctgtgagg

SEQ ID NO: 37848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggaaacagcctatcttgtcggttgcgcac

SEQ ID NO: 37849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggaaatggggcgccatccatccgccaacg

SEQ ID NO: 37850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggaacggttacacaacataacttctctta

SEQ ID NO: 37851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggaacggttgaaccctcaaggacgcgcgc

SEQ ID NO: 37852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggaacgtcaggcaggagccgccattcggg

SEQ ID NO: 37853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggaagctcctgaggcttgctgatactgtt

SEQ ID NO: 37854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggaaggagcgaacggtgtacttggtggag

SEQ ID NO: 37855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggaaggtgacacccatcgttgcacccttc

SEQ ID NO: 37856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggaagtagatgaccgggcaagagttcgcg

SEQ ID NO: 37857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggaagtatgctttcgtcatcttagttgta

SEQ ID NO: 37858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggaatctcggcggtagcactttttgggtg

SEQ ID NO: 37859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggaatgatctgccagtccgacgccatcat

SEQ ID NO: 37860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggaatgtcagagtatatcttagtcatcgc

SEQ ID NO: 37861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggaatttgcagaggcccggattctttggc

SEQ ID NO: 37862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggacaaagcttcgtagttctagagtcact

SEQ ID NO: 37863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggacggatgatctgatttacaaagtgcac

SEQ ID NO: 37864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggacgggttactgtcatgcggctggtgag

SEQ ID NO: 37865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggacgttcttagccaaacgacatctgccc

SEQ ID NO: 37866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggagaaatcggtcgttcgtggaatacctg

SEQ ID NO: 37867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggagaataaaagccgctgtcgtgacaagg

SEQ ID NO: 37868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggagacgggtacggcgggtagctgatcgc

SEQ ID NO: 37869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggagaggacggcttaaccatggctcgtcg

SEQ ID NO: 37870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggagcagcttgcagaaataataccctcgg

SEQ ID NO: 37871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggagccagaagtattgtctcatagcccct

SEQ ID NO: 37872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggagcgatgcgcgatgttggctccccggg

SEQ ID NO: 37873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggagcgcgcaaaagaggagctcgttgcga

SEQ ID NO: 37874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggaggtcaatcgaatgatagccctttacg

SEQ ID NO: 37875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggagtcctgtattgaggccggtgccggta

SEQ ID NO: 37876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggataagctagggtggacccgctatcggt

SEQ ID NO: 37877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggatcgcggggcacagctacgaaattagg

SEQ ID NO: 37878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggatcgttgcattcgtcgagctgggtatg

SEQ ID NO: 37879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggattcaccacggattcgagaggtttact

SEQ ID NO: 37880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggattctaggtgcttgttactaaaggatg

SEQ ID NO: 37881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggattcttgatacaattgcacgcacgcat

SEQ ID NO: 37882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcaacgggccatggtcgtgagtccacaa

SEQ ID NO: 37883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcaattaacatcatccgattaaatattt

SEQ ID NO: 37884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcacaactcgccgattacgcggcctctc

SEQ ID NO: 37885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcacagtaccgcgcggtggtcactgccc

SEQ ID NO: 37886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcacttagctgctaccataaccctggtt

SEQ ID NO: 37887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcagcactagacgcttggttagggaggc

SEQ ID NO: 37888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcagctagagtcaccggatcaccgattg

SEQ ID NO: 37889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcaggcattgttgccgcaatacggggcg

SEQ ID NO: 37890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcaggtggcgttccatggtttcgggttt

SEQ ID NO: 37891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcatcccgcactcgtccgcgctatctgt

SEQ ID NO: 37892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcatcgagacgacctttaaccatgtacc

SEQ ID NO: 37893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcatcggcacatttagcttgtccacggt

SEQ ID NO: 37894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcatggggtcgggtgagtgcatcgcggg

SEQ ID NO: 37895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggccaacacatcaattcccgtacggtgct

SEQ ID NO: 37896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggccaagttcgaggatacacccttgagcc

SEQ ID NO: 37897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggccacgctggcgggaaagctcgtagcta

SEQ ID NO: 37898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggccagccttgatctgtgttagccggttc

SEQ ID NO: 37899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggccatttcgggtgagtttgtgctcggga

SEQ ID NO: 37900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggccccattcagtgtgtaaaggcgtcgcc

SEQ ID NO: 37901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcccgacaatgagcgctcgctacctact

SEQ ID NO: 37902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcccggtagcagtgatcttggctgggaa

SEQ ID NO: 37903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcccgttctttcgattgagatttgctct

SEQ ID NO: 37904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggccgccaagggcaaatcgtacggcaagt

SEQ ID NO: 37905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcgaaccatcgatccgaagttgcgcttc

SEQ ID NO: 37906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcgaaccgaggccgtattgaccggcgac

SEQ ID NO: 37907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcgaagggtggctacacgattggagtgg

SEQ ID NO: 37908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcgaccgagtaagttatgaggcggaatt

SEQ ID NO: 37909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcgacgagccatgcacagatcggggcac

SEQ ID NO: 37910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcgagaggatgatgttagactccgcagg

SEQ ID NO: 37911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcgatgagaaacagttgtgtgtttcctg

SEQ ID NO: 37912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcgcaagtatatcgctttaagtagttgg

SEQ ID NO: 37913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcgcatatcactccgtagatgttaatca

SEQ ID NO: 37914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcgccattcctggatcgcagccgcttcg

SEQ ID NO: 37915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcgccgagttaagagcgtcatctacttc

SEQ ID NO: 37916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcggcgggcttatataccggttgaagtg

SEQ ID NO: 37917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcgggtactagggtatgggagcctcttg

SEQ ID NO: 37918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcgtaagtgaattagacgtagacttccg

SEQ ID NO: 37919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcgtacttgggtgccgggagtcgttacg

SEQ ID NO: 37920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcgtgcggtttacgtgtgtcatccgctt

SEQ ID NO: 37921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcgtggaacatagcccgatctttagcca

SEQ ID NO: 37922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcgtgggaggaagtatcgcgatacacct

SEQ ID NO: 37923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcgtggtgggtgtatctgtaccgctatg

SEQ ID NO: 37924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggctaccactggtgcgagttgtcgtacaa

SEQ ID NO: 37925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggctacggtcgttaatgctgcggcgatcg

SEQ ID NO: 37926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggctcagaaagcacgagccagggcatgga

SEQ ID NO: 37927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggctccatggtggtacgtctttcgtgcgg

SEQ ID NO: 37928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggctccggcaggtaatttccacctttgcg

SEQ ID NO: 37929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggctccgggggcctcgtcgcccgacctgt

SEQ ID NO: 37930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggctgacggactcggcgggctgggtttga

SEQ ID NO: 37931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggctgtgcatggccgtgacgttaaaccgc

SEQ ID NO: 37932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggctgttaggcgttagactataattccca

SEQ ID NO: 37933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggcttggctaacttgctttagaatagctg

SEQ ID NO: 37934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggctttgctcgacgccgccatcagggacg

SEQ ID NO: 37935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggaacgcgcctgagtttgagtagatagg

SEQ ID NO: 37936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggaagtgctctcgtatgctcgacgctac

SEQ ID NO: 37937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggacataaccttgcagaccggcacgctt

SEQ ID NO: 37938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggaccacggactatctcgggactgggcg

SEQ ID NO: 37939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggattgatgtaaccgtgcgtctggcatg

SEQ ID NO: 37940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggcagatcctcgtgcgcgggagggtaat

SEQ ID NO: 37941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggcaggggagtagcagtggtgagatcgt

SEQ ID NO: 37942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggcagtttgaggtaggcgtagtttgtga

SEQ ID NO: 37943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggccaaccgggtacggggaaggcgagcg

SEQ ID NO: 37944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggccacctccagtatttttagtggggtt

SEQ ID NO: 37945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggcgaaaaggggtgcgccttaacccttc

SEQ ID NO: 37946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggcgcgtcctgacagcacaggggaggag

SEQ ID NO: 37947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggggatgcttcgcaagggttgcaggctat

SEQ ID NO: 37948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggggcactggtttgcggtcaggctcgagg

SEQ ID NO: 37949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggggcatcgggtaggtcgggagggcatag

SEQ ID NO: 37950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggggctatcgcatgttacccaatcgtctc

SEQ ID NO: 37951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggggctccggccaatagctctcccgaggc

SEQ ID NO: 37952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggggcttccagggcattgctcatgaaaac

SEQ ID NO: 37953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggggggcgcggtggcaatgctatcgtgga

SEQ ID NO: 37954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggggtacacttaagcatgatgcctgcaa

SEQ ID NO: 37955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggggtttggactaacgatatccgagaaa

SEQ ID NO: 37956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggggtcgttcacacgttttccttactggc

SEQ ID NO: 37957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggggtttcagatacacagttggctagtgc

SEQ ID NO: 37958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggtacctcggtggcccttcataggtatt

SEQ ID NO: 37959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggtcgtacaaataaggtgtgggcgttgt

SEQ ID NO: 37960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggtcgtatacgctctacccaattgtgtg

SEQ ID NO: 37961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggtgaatgttgtgcgcccaatcgcttgc

SEQ ID NO: 37962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggttatatggtggtgcttcgtcttgttt

SEQ ID NO: 37963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgggttcaatgtctcgctcgccatattcgc

SEQ ID NO: 37964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtaacgacaatcgcaggagtggggtttc

SEQ ID NO: 37965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtaataagaccgttttgcctcagtctgc

SEQ ID NO: 37966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtagaacatgtttattttggcggacaat

SEQ ID NO: 37967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtagcggggatagagagcaaggtgcgaa

SEQ ID NO: 37968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtatcttcgggagttcggattaaggttc

SEQ ID NO: 37969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtattcatgagcttcgactgcgcttcta

SEQ ID NO: 37970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtattcgtggtgattgtgtgcttcggtt

SEQ ID NO: 37971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtattcttacccaaacctcagctgtacg

SEQ ID NO: 37972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtcacggagcacgaatccgaagttggtc

SEQ ID NO: 37973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtcatggtttcgattcgccccaactttg

SEQ ID NO: 37974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtcgctggtgccgtccgtggcggttgca

SEQ ID NO: 37975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtcggcatgggggacgcaagttagggca

SEQ ID NO: 37976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtcggctccgttgtcgaaacgcggaata

SEQ ID NO: 37977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtctcaccctggaggcttggtggccatg

SEQ ID NO: 37978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtctcagagtttcgagtcctgaaggcgg

SEQ ID NO: 37979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtcttcattgccatacgttggaccggtg

SEQ ID NO: 37980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtgagggttggatcttgaaccacccagc

SEQ ID NO: 37981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtgatctgaccacggaaggtgacgcgcg

SEQ ID NO: 37982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtgcggttcggtattcgtgattcaggcg

SEQ ID NO: 37983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtggacgtgtgttgtctgcaatacagcg

SEQ ID NO: 37984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtggcacgccgagcccgtcatccgattg

SEQ ID NO: 37985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtggcagaatcgtataatggcgttgcta

SEQ ID NO: 37986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtggctattaacgtaggagtcactaacg

SEQ ID NO: 37987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtgtggcggtgtcgagccccaacacttc

SEQ ID NO: 37988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggttccagcaaggcgaaggggagcgttat

SEQ ID NO: 37989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggttctaaactacatcgtcgctgttcttc

SEQ ID NO: 37990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggttgagagagtcacgagtgttatgtcac

SEQ ID NO: 37991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggttgcacttcgaatctgggggggttacg

SEQ ID NO: 37992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtttgccttcttctttcaggtgtagcta

SEQ ID NO: 37993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtttggctccatcatttgtgatgctcct

SEQ ID NO: 37994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacggtttttactgcatcgagtatgtgcgccg

SEQ ID NO: 37995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtaaagtcatctctcctcacttgcattcc

SEQ ID NO: 37996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtaaagtttcgctcctctggatggatcga

SEQ ID NO: 37997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtacacgcaaaaaggatatcgagcgcgac

SEQ ID NO: 37998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtaccgtagggtgttgtttccaactttgc

SEQ ID NO: 37999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtacctgggggtatcaatgaggtcagcgg

SEQ ID NO: 38000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtagcggttcgtgttagccgcggacattc

SEQ ID NO: 38001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtagctttgggacgctgaggtgcgtgctg

SEQ ID NO: 38002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtaggcaacatgctaaacggtaaaagctc

SEQ ID NO: 38003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtaggctaattgggaaccgtgcacagatg

SEQ ID NO: 38004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtagggttaaccggtccatgggatagctt

SEQ ID NO: 38005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtatacgctcattttcacccgactatttg

SEQ ID NO: 38006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtatcccacggtgagcaagacctctagcc

SEQ ID NO: 38007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtattgacattggatacgctatgggcatc

SEQ ID NO: 38008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtcacgattggcacgtgcgcctcctccgc

SEQ ID NO: 38009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtcactgtttgtcttgattgcgtaactgc

SEQ ID NO: 38010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtcagaatcacgcacggtactctcagcgg

SEQ ID NO: 38011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtcatacattgttaggaccgtgctggaaa

SEQ ID NO: 38012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtcatctagtttcaggcaggttcggtgat

SEQ ID NO: 38013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtcatgtttggaaatcaacggggcggaca

SEQ ID NO: 38014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtcccagggtcggtgtcgatcggttgggg

SEQ ID NO: 38015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtccccactcacaagccgagagttcaatg

SEQ ID NO: 38016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtccgatgattgaaaatgcactggctggt

SEQ ID NO: 38017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtccgattcgtccaatcagtccacaacta

SEQ ID NO: 38018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtccgtgcggcaatcttattgttatacgc

SEQ ID NO: 38019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtcctggcatccttgttaggtggcgttcg

SEQ ID NO: 38020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtccttttatcgcagtcattagtctcgcc

SEQ ID NO: 38021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtcgacgcgaggtctatatgcgcatcggg

SEQ ID NO: 38022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtcgcgactcgttcgcttggtgttaacgg

SEQ ID NO: 38023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtcgcggatagcccttagcctggtaatgt

SEQ ID NO: 38024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtcgcgggttcgttagtgacagcattaag

SEQ ID NO: 38025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtcggaaccgtgttcctaaggccgggtct

SEQ ID NO: 38026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtcgggaccggggatgtgctggcgcgtcg

SEQ ID NO: 38027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtcggtgcttgtttaccgcctgcagcctg

SEQ ID NO: 38028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtcgtcgtgcatgcatgagcacctgatac

SEQ ID NO: 38029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtcgtgagcggggatgtttgtttttgagt

SEQ ID NO: 38030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtcgtgggctttaaaccggcttgacccga

SEQ ID NO: 38031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtctaattaggtgtctggttatcatgtaa

SEQ ID NO: 38032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtctactgtggtgacttttggggtcggtc

SEQ ID NO: 38033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtctcgggaggtcctggaatttcggctct

SEQ ID NO: 38034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtctctggcgggatctcgggctgggtttg

SEQ ID NO: 38035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtctctggtcgctaggctagccttctccc

SEQ ID NO: 38036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtctttcccaaggcagcgccgggccaggg

SEQ ID NO: 38037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgaacccctcggctacctaatgctctgg

SEQ ID NO: 38038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgacacatgaatggggtgtgcggtcccg

SEQ ID NO: 38039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgactggggacgtcattcgagtaccggc

SEQ ID NO: 38040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgaggggcactggcgtcgttgtagctgt

SEQ ID NO: 38041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgagttcgaggaagggtcgctgcgtgtg

SEQ ID NO: 38042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgatgcggaggggtgggcaggcctgtta

SEQ ID NO: 38043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgcaaggcagaacaggctcaccgaccca

SEQ ID NO: 38044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgcacgccgcattatacgattagtgtgg

SEQ ID NO: 38045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgcattttgtgtagtccttcatctgtgg

SEQ ID NO: 38046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgcctacgaggtcttttaagcatcacgg

SEQ ID NO: 38047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgcgcgggcggctttgtaaagactgcat

SEQ ID NO: 38048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgcgcttaaacattaaacccgttttgtt

SEQ ID NO: 38049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgcggcgtcgtgtgtaccggtaattcac

SEQ ID NO: 38050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgcgtttgtaagttcacggcggacgtcc

SEQ ID NO: 38051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgctaaccttcaattcggcgcccgttct

SEQ ID NO: 38052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgctccggttgagagcatactcatactg

SEQ ID NO: 38053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtggaccagctcgtgcatcgtgcgttagg

SEQ ID NO: 38054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtggagactgacattggatcgacatggtg

SEQ ID NO: 38055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtggcacagtcctggagacaacacgggct

SEQ ID NO: 38056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtggcatctcgtcgaggaccacttctgcg

SEQ ID NO: 38057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgggctagcggatatcatgagtgctacg

SEQ ID NO: 38058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgggtgcaagggaatgatgaataggagc

SEQ ID NO: 38059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtggtgccggtcccggctcgggatgcttt

SEQ ID NO: 38060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtggtggcggggtttttagtgtcgagacg

SEQ ID NO: 38061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgtaataggtctgtgcagctatcggttg

SEQ ID NO: 38062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgtagattgcctcgggttgcaacggtct

SEQ ID NO: 38063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgtattcaacaaaataagatgccactct

SEQ ID NO: 38064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgtgagatggatagcgggcagtgcgctg

SEQ ID NO: 38065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgtggagcagccggggtcgttatgggca

SEQ ID NO: 38066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgtggagtcgaaccgttccttgaccgtg

SEQ ID NO: 38067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgtggcgcaggatcgtcaagtcataggg

SEQ ID NO: 38068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgtgtggcaacttgctgttatgcgtgcg

SEQ ID NO: 38069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgttcataacggtttccgggccggctcg

SEQ ID NO: 38070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgttgaaagtgttggaggtgcctttgcc

SEQ ID NO: 38071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtgttgtttgacgctccataacatattct

SEQ ID NO: 38072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttaacatattgcccggtgttttgactgg

SEQ ID NO: 38073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttaacttaggattgccctaattgttgct

SEQ ID NO: 38074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttacctgttagctcctgtcatgctggac

SEQ ID NO: 38075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttaggcgacacctccctagcctcacttg

SEQ ID NO: 38076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttcaatgcacacttactgattaactaag

SEQ ID NO: 38077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttcccaatttcgacctgggctggacctc

SEQ ID NO: 38078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttcgcagagcctgccgggattggtgttc

SEQ ID NO: 38079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttcgccagcaccgcgctaagggattgtt

SEQ ID NO: 38080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttcgctttgatctctcgaatcgatttat

SEQ ID NO: 38081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttctattctaatatttattcttcgcttt

SEQ ID NO: 38082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttctcggcagggtggactgggactaccg

SEQ ID NO: 38083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttgcaatagatggtcggctgtggaggac

SEQ ID NO: 38084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttgcagatcgactggcgatgacgctgtc

SEQ ID NO: 38085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttgcaggtcctctatcgtccgatagagc

SEQ ID NO: 38086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttgcagttttacgaggtcctaccctgga

SEQ ID NO: 38087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttgcgcgaagggacggacccctgatgcc

SEQ ID NO: 38088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttgctctttatcagatacccggggtgag

SEQ ID NO: 38089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttggcagaacgggagtcccggttaccct

SEQ ID NO: 38090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttggtgcgcgtcgctgagtccccgtcga

SEQ ID NO: 38091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttgtactttaacgttcgagttactgctc

SEQ ID NO: 38092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttgttagagcgctatccttgattctctg

SEQ ID NO: 38093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgtttcagaagacgctatgatatcacctgg

SEQ ID NO: 38094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttttcattagcacgcttactctagccta

SEQ ID NO: 38095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacgttttcggttggaagcataaaatggtggc

SEQ ID NO: 38096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactaaaacacccgttctaaatggcctcgagg

SEQ ID NO: 38097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactaaacaccgcgacaacgccgtcaacagtc

SEQ ID NO: 38098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactaaagcatgtactccgttcgcagacgccg

SEQ ID NO: 38099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactaaatcttttcgcccgtgtcccccctgct

SEQ ID NO: 38100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactaaattgttatttgttggaataaagatac

SEQ ID NO: 38101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactaacagggatcctatgactgtcacataag

SEQ ID NO: 38102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactaacccgggttatagttgtgtggaccctc

SEQ ID NO: 38103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactaaccggatcgtacacgcatctcgtcgtc

SEQ ID NO: 38104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactaaccttggatggagttatgcgtatcgtt

SEQ ID NO: 38105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactaactccacagtctgttagaagcttccgc

SEQ ID NO: 38106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactaactcgcggtacagtcggtttacacacg

SEQ ID NO: 38107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactaaggcagccgcgtacgaagtcctggatt

SEQ ID NO: 38108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactaatgcagacaacccatccgttagcgacc

SEQ ID NO: 38109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactaatgtaggaatcgttgtgttttgattgt

SEQ ID NO: 38110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactacaaaaatcgctcggggtacgtctgctt

SEQ ID NO: 38111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactacacaaagtcgggtaggcctgcccatat

SEQ ID NO: 38112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactacacgcaacatagtacagccaggtcctc

SEQ ID NO: 38113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactacccctcgcgagttacaccttcggagcg

SEQ ID NO: 38114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactacgaatgatgggccattaatcgggttcc

SEQ ID NO: 38115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactacgagcctaatgtgtcttgcccgtttga

SEQ ID NO: 38116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactacgaggggaagacaccgactccgtttac

SEQ ID NO: 38117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactacggcggagcttggactttcgtgcaatg

SEQ ID NO: 38118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactacggtctttttggcagctcaccggcgtt

SEQ ID NO: 38119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactacggttcaaaagtagagacttgttgcct

SEQ ID NO: 38120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactacgtgaatggtgatcaaggatggtgtgg

SEQ ID NO: 38121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactactcttatattgctcaccactgtaacgt

SEQ ID NO: 38122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactactgtggctttatccttactttcgactc

SEQ ID NO: 38123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactagaaacctctccacatgtgtgtcatatg

SEQ ID NO: 38124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactagaaaggctgtcagcaggcttgctgaac

SEQ ID NO: 38125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactagaatgatctttctgtacaggtctctta

SEQ ID NO: 38126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactagagcatcaccggcttttcatcgcacta

SEQ ID NO: 38127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactagcccgttgaccgttgtgatcctcgttg

SEQ ID NO: 38128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactagcgagtagaaaggaatcccccatgttc

SEQ ID NO: 38129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactagcggacagcgcggtgcggccgtgtaac

SEQ ID NO: 38130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactaggcacggtgcggacgcagctgtatcat

SEQ ID NO: 38131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactaggggagcgacgcgacaatcgaatcggt

SEQ ID NO: 38132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactagggtactacgatgagtcagcttcgagc

SEQ ID NO: 38133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactagggttatagaatcacacacactgctta

SEQ ID NO: 38134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactaggttctggccggactatgtgttgactg

SEQ ID NO: 38135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactagtagtagagaaacgattgtcagcgacg

SEQ ID NO: 38136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactagtgtaagtcacatggcgggtttctgtc

SEQ ID NO: 38137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactagtttctggtcgagtctcgcgggtgtac

SEQ ID NO: 38138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactatacttgacgtctgggatgctgttagac

SEQ ID NO: 38139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactatagccttcgctctggattgcagccgtg

SEQ ID NO: 38140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactatatccagctggacatatcaaattcagt

SEQ ID NO: 38141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactatcccttaaccataaagtacgcaggtag

SEQ ID NO: 38142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactatccggattaaaacaggtggtctggaca

SEQ ID NO: 38143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactatcgctgatcggggagagttgtttaggt

SEQ ID NO: 38144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactatcgttccagatgtctacctcgctccgt

SEQ ID NO: 38145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactatgcaggctacatggaacgtcttcgaac

SEQ ID NO: 38146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactatggcggggcatgcctccagttgaggcg

SEQ ID NO: 38147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactatgttgcagcgattgtgtttctggccta

SEQ ID NO: 38148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactattcaatctttcaggctcgtttgacatt

SEQ ID NO: 38149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactattcttgggctctaaaaaactgacgtga

SEQ ID NO: 38150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcaaagacaggcccagacacggcacccga

SEQ ID NO: 38151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcaaattttctatacgcctctgggataaa

SEQ ID NO: 38152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcaagatcatggtgtagtcacgggtccga

SEQ ID NO: 38153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcaagatgtggcccctcgaagcattgaat

SEQ ID NO: 38154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcacaatttatttccatcaaagggactcc

SEQ ID NO: 38155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcacagacgagtatgaccgcttgcttcgc

SEQ ID NO: 38156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcaccggggatctctggcttgccctagta

SEQ ID NO: 38157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcacgaacgtttcaggctacgctttttgg

SEQ ID NO: 38158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcacgcagatcgcgatcggtaggctcacg

SEQ ID NO: 38159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcacgctatgtttagctcgggttaaggct

SEQ ID NO: 38160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcacggcctttgctaagccaagacatccg

SEQ ID NO: 38161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcactatcctgcattgcgatttactcccc

SEQ ID NO: 38162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcacttccgccgagaacgctccatcaggc

SEQ ID NO: 38163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcagagcgaccaggacctgaaggcttccc

SEQ ID NO: 38164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcagagggcgaaagtgcatgtgacgggcc

SEQ ID NO: 38165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcagcatacaaccgctgcttatttggatt

SEQ ID NO: 38166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcagccgcagaaacttgccactgtagatt

SEQ ID NO: 38167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcaggccataacgtttatggtggttatgt

SEQ ID NO: 38168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcagtgcggatcacattttagaggctccc

SEQ ID NO: 38169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcagtggaaaacgtagcagaacgaatcaa

SEQ ID NO: 38170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcatcgcttcgaacccaagctggctcagg

SEQ ID NO: 38171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcatggattgaaacggccgtaacgacgag

SEQ ID NO: 38172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcatggcccccttaccacgactgggatgg

SEQ ID NO: 38173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcatgggcaaacttcgatgtcctgcaggt

SEQ ID NO: 38174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcatgggcggcctctcgtttacgttctag

SEQ ID NO: 38175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcattttagcacgtgggccctacgcagcg

SEQ ID NO: 38176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactccaaggacggtcggccgctgggtgcctg

SEQ ID NO: 38177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactccaccgacttccatagctggtacggacg

SEQ ID NO: 38178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcccctagatgggctcgcccgcttggttg

SEQ ID NO: 38179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcccgaataccgtcctatagtctatgccc

SEQ ID NO: 38180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcccgtcacctctcgtcttcatcccgtgc

SEQ ID NO: 38181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcccgtgctgccggccaagcgcttgtacg

SEQ ID NO: 38182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactccgacgcacattggcttaagacccgggg

SEQ ID NO: 38183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactccgcaaggcgggacgagttggctacccg

SEQ ID NO: 38184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactccgcttcagctagacgtcatatgttagc

SEQ ID NO: 38185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactccgggaaacgtgcgaccattatccagga

SEQ ID NO: 38186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactccgtgaccgccctttttgattgacctgt

SEQ ID NO: 38187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcctacgcctggttctttacagttattgc

SEQ ID NO: 38188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcctgcagaagtcaacgacgagggcagtg

SEQ ID NO: 38189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgaagggtagcgaatccgtgtggctggc

SEQ ID NO: 38190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgacaccgcacaggaacggctagtgttg

SEQ ID NO: 38191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgacggttgtacactcctcttcctatcc

SEQ ID NO: 38192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgagactaaagacaggttccaacgttgc

SEQ ID NO: 38193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgagaggcaggcgtcttctctgtacgtg

SEQ ID NO: 38194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgattgacgcaatgccgttcgctctgtg

SEQ ID NO: 38195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgcagctcggttttataagcgggagtgt

SEQ ID NO: 38196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgccgtgtggcgattggtttccgtgtca

SEQ ID NO: 38197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgcctagctagataggggtctcggtcga

SEQ ID NO: 38198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgcggcatgggtacatggcaacggagct

SEQ ID NO: 38199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgcggctgtatcttgctaatcggcgcaa

SEQ ID NO: 38200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgcgggacggtttgagcataacgtaata

SEQ ID NO: 38201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgcggtggaggaagataatgccaggtgc

SEQ ID NO: 38202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgcgttccagacttcagcctcattcatg

SEQ ID NO: 38203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgctaatacacatccggtcacggtccgg

SEQ ID NO: 38204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgctgtgtggtacaattggtatccagtt

SEQ ID NO: 38205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgcttggaatggctaccaatgtacaggc

SEQ ID NO: 38206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcggaatgggcaccggtgtggccaagttt

SEQ ID NO: 38207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcggaccacttgttgtatcgtatgatgtc

SEQ ID NO: 38208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcggattcgcaccgctcaatgggtagccg

SEQ ID NO: 38209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgggttagtgttggctagctcgcttctg

SEQ ID NO: 38210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcggtacatgccagctgcggcaaagttcg

SEQ ID NO: 38211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcggtttgaatttgccgccgcggtgatct

SEQ ID NO: 38212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgtacgcaatgggggcgcggatgtacgt

SEQ ID NO: 38213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgtaggggactgggtatgtcatgacacg

SEQ ID NO: 38214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgtcctggcgccaacaaaggtaactcat

SEQ ID NO: 38215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgtcgacgggagctagccctgtttgtgt

SEQ ID NO: 38216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgtcttcacactcctttggcctcttttt

SEQ ID NO: 38217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgttaagatgggatcgcacgggtctttg

SEQ ID NO: 38218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcgttcctagttttcccggtgaaaacact

SEQ ID NO: 38219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactctaaccaggtttctgccgccacatccat

SEQ ID NO: 38220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactctacataggttaccctgcagcacgcttg

SEQ ID NO: 38221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactctatgagggggctcactgaagcttcaat

SEQ ID NO: 38222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactctcgtatattggaagcgcccgccaagag

SEQ ID NO: 38223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactctcgtatcgctgcgagttgacgttatgg

SEQ ID NO: 38224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactctctaattggcttgtcgttacttacagt

SEQ ID NO: 38225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactctgaccctactgatcgcttcgtcgacct

SEQ ID NO: 38226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactctgactacggtggatgctccctagggcg

SEQ ID NO: 38227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactctgagttcgggtcagctcccgagcatgt

SEQ ID NO: 38228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactctgccaccgatccgcgtaatttaacccc

SEQ ID NO: 38229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactctgcttcggtagaccgcgtgcatatttc

SEQ ID NO: 38230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactctggagacctgtttaactactttccata

SEQ ID NO: 38231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactctgggcacaggtcgcaagtcggttggga

SEQ ID NO: 38232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactctgtgctcggtgttcttacgacatctcg

SEQ ID NO: 38233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcttccccaagtggtctcaacatgcgtca

SEQ ID NO: 38234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcttccgacgcctgcagtgcaatcatgtt

SEQ ID NO: 38235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactcttgccaggggtcattcagccgagggtc

SEQ ID NO: 38236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactctttaagtgcgggtgcaattctttgact

SEQ ID NO: 38237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactctttagccccccccttggttcttagtgg

SEQ ID NO: 38238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgaaacacacgctcttcgccccgttacga

SEQ ID NO: 38239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgaacagcgcgggaggtgcatcctccagt

SEQ ID NO: 38240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgaacaggcagtcatgtgctccgtgccga

SEQ ID NO: 38241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgaagtaaccagtaaccgagccccctcga

SEQ ID NO: 38242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgacgcccggatgacggtagcacgcgaac

SEQ ID NO: 38243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgacgcgtactcatcgaatgcttcttctg

SEQ ID NO: 38244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgactgggcttaacatacaaagctgtcct

SEQ ID NO: 38245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgaggcagagtttccgtgaagatcgttcg

SEQ ID NO: 38246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgaggcatgcgggatcttgggacggtggg

SEQ ID NO: 38247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgaggggtttatcgctgttctctgcgctt

SEQ ID NO: 38248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgagggtgcgtcttgctggttagtacggc

SEQ ID NO: 38249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgagtattgaggcggcactccggaggttg

SEQ ID NO: 38250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgagtgaattttgcccttcactggttctc

SEQ ID NO: 38251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgatcagtctctaaaagtccgcgatcgtg

SEQ ID NO: 38252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgatgaggaacgagaggaagattcgattg

SEQ ID NO: 38253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgcaaaccgagtaattggcatagcagtaa

SEQ ID NO: 38254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgcaaatcgtgtatcaatcactactgggt

SEQ ID NO: 38255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgcaagggagagttggtaaactgcagcgc

SEQ ID NO: 38256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgcactcgaagcccgtgcgcgactgaaaa

SEQ ID NO: 38257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgcatcctatggtgtgtgcacccttatgg

SEQ ID NO: 38258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgcatgtgccgctacagattggttcaacg

SEQ ID NO: 38259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgcccaaaagaaagcgaccgagacctgag

SEQ ID NO: 38260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgccgatcaacgtccatgggcctgcttcg

SEQ ID NO: 38261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgcctcagttccgggtggctttggcgatc

SEQ ID NO: 38262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgcgatcgagctgctggttattcacagga

SEQ ID NO: 38263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgcgcacgtccgttattagtgtctgggta

SEQ ID NO: 38264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgcgcaggtgggcgaaagtgctaactccg

SEQ ID NO: 38265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgcgcatcaatctcatgatcgacgtccta

SEQ ID NO: 38266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgcggaacataatcctgatgtgaaacggg

SEQ ID NO: 38267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgcgtaagagtcatccgtgtcgacaggca

SEQ ID NO: 38268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgctatccatggcggcgttcgctgtatgc

SEQ ID NO: 38269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgctattcgcaaatccggacaatcgcatg

SEQ ID NO: 38270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgctgctttagctaattggaacacgtccg

SEQ ID NO: 38271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgctgtatgtgcccgacccctagcgtgag

SEQ ID NO: 38272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgcttggttgccagtgggggctatacctc

SEQ ID NO: 38273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactggaccgcctctcccatttgttgtgagct

SEQ ID NO: 38274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactggacctaaatgttcaatttcgggtggcc

SEQ ID NO: 38275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactggacggaagacgttgttattcctgaggg

SEQ ID NO: 38276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactggatattacgtactactagtgacatgcc

SEQ ID NO: 38277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactggcaatgcgtgcgcttatgactagtatc

SEQ ID NO: 38278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactggccacgcgcacagcccttgcgggtgcg

SEQ ID NO: 38279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactggccttggtaggtgcgaatgaggatcga

SEQ ID NO: 38280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactggcgatcaattgttttgggcttgtgtcg

SEQ ID NO: 38281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactggcgctcatgcgtcaatgtgccggcatg

SEQ ID NO: 38282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactggctgaataggtagtccacgccagggtc

SEQ ID NO: 38283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgggaagggtgtcacattcgctgggcggg

SEQ ID NO: 38284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgggacgggagcgactacgaattaagcgg

SEQ ID NO: 38285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgggaggccgagattgaatcatttcgtcg

SEQ ID NO: 38286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgggcctgtgtttgttattcttcgtttcg

SEQ ID NO: 38287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactggggtaaacgaggagctcactcagggca

SEQ ID NO: 38288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactggggtggggtgcggccgtagctacttgg

SEQ ID NO: 38289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgggtgtctgatcaacgtggggatgcctc

SEQ ID NO: 38290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgggtgtgatgactaagtcgtgcacgttg

SEQ ID NO: 38291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactggtattcgtctctcgtaatatgatttga

SEQ ID NO: 38292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactggtttcggcttgccgtaactctcggcgg

SEQ ID NO: 38293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtagcgtcgttccggagtgacacgatgg

SEQ ID NO: 38294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtaggctgggtgcatttcgttcgtctag

SEQ ID NO: 38295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtatatctcagcgccctttgtatggtgt

SEQ ID NO: 38296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtatgctgatcttttgtattactatccg

SEQ ID NO: 38297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtcaactgtctagcttggtccttgttgc

SEQ ID NO: 38298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtccactaaccctaatttactttctcac

SEQ ID NO: 38299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtcctgtcgtgctgcccggggagcaccg

SEQ ID NO: 38300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtcgcggcgtttcttcgccctagcttac

SEQ ID NO: 38301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtcgctaaacgccatttggtacccaggc

SEQ ID NO: 38302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtctcacttgtagacgcgatatcggaca

SEQ ID NO: 38303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtgaggcccctggagcatctgtgccgac

SEQ ID NO: 38304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtgatcgactttgcagagtcattcgcct

SEQ ID NO: 38305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtgcacgtagatttcgtggtactctcta

SEQ ID NO: 38306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtgcatgaggcggatggaggggtttgtg

SEQ ID NO: 38307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtgcggtctgctggtagacgctgaatcc

SEQ ID NO: 38308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtgggtttacgtcttagggcgctgcaaa

SEQ ID NO: 38309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtgtctggggttgggtcgggcgattgtg

SEQ ID NO: 38310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtgttacgacgggtaccgatggttaggt

SEQ ID NO: 38311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgttaccatggatctatcattaaccggtt

SEQ ID NO: 38312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgttagcttgaggaaccgggtgatccctt

SEQ ID NO: 38313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgttagggtctctttgtggctcatggcct

SEQ ID NO: 38314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgttagtgctgatgggtaaaaggaagacg

SEQ ID NO: 38315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgttgttagtcccatctacccggatctcg

SEQ ID NO: 38316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtttcaatacatgcggaactcaggatcc

SEQ ID NO: 38317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgtttggagttaacgaaatgaaatgcgaa

SEQ ID NO: 38318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgttttacatttagtatgtggtgtcagct

SEQ ID NO: 38319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactgttttcctctggtattattactacgtgt

SEQ ID NO: 38320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttaacagacagggctctcattatacagct

SEQ ID NO: 38321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttaacgcgctagcatttggtcacaggttt

SEQ ID NO: 38322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttaacgtaactaatctgcggtctggacaa

SEQ ID NO: 38323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttacggacatcggtctctttgggaccagc

SEQ ID NO: 38324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttacggagctcagtgctggccttttagtg

SEQ ID NO: 38325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttacttaggttgttcgtatgcttgaccgt

SEQ ID NO: 38326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttagattcacacttaatcggggcaaccgg

SEQ ID NO: 38327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttagcactttgtggcgtatgcgctcctgt

SEQ ID NO: 38328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttaggacgtcgtccgtcgctgggttttgc

SEQ ID NO: 38329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttaggccagctgctggtgagaaccgttcg

SEQ ID NO: 38330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttaggccgccgctaacgaagacctttggc

SEQ ID NO: 38331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttaggttcggagttgctactgtcttcgcg

SEQ ID NO: 38332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttaggttgtgttacagaattattcaccga

SEQ ID NO: 38333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttatatttacgcccaagcgatcgggatct

SEQ ID NO: 38334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttatgcgggtgtcgggtcgcaagcgcggc

SEQ ID NO: 38335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttatggatgggcgagaactctggccactt

SEQ ID NO: 38336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttcaatgatctctctgcaaggtttcggcc

SEQ ID NO: 38337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttcacagcgtcggtggttggtagcaggtt

SEQ ID NO: 38338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttcagtgtatatttcacggatgctggtct

SEQ ID NO: 38339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttcataattacagcgtagttgagcttgag

SEQ ID NO: 38340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttcatggcaaccgggacagacttacgtac

SEQ ID NO: 38341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttcatgtaggcattccaccagcgtttcat

SEQ ID NO: 38342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttccactagtatatggggattgaagggga

SEQ ID NO: 38343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttccagttttgttctcactggatctgttg

SEQ ID NO: 38344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttccgccatgggtacctcacgtgcgggat

SEQ ID NO: 38345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttccgcgatttctttgggttatcgtttga

SEQ ID NO: 38346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttcctattacagataagcacgcgccgctc

SEQ ID NO: 38347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttcgacttgactccgttacggtgaagaca

SEQ ID NO: 38348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttcgcacactgattatgtacggtggccat

SEQ ID NO: 38349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttcgcttcctcgttgtattgccgtcgtcc

SEQ ID NO: 38350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttcggagctgggtcacgacaatgcccggc

SEQ ID NO: 38351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttcggcctgcgcgtgcatatgagggtttg

SEQ ID NO: 38352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttcggcggggagaatcggtcgcatgcgta

SEQ ID NO: 38353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttcggcttgatgagtgccgcttcaatcgg

SEQ ID NO: 38354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttcgtggggctcgtattgcacgatactta

SEQ ID NO: 38355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttctgcccagcaaacgatagccttgaggg

SEQ ID NO: 38356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttcttgaccctgattgggctgaattccga

SEQ ID NO: 38357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttgaacaaactcggatttcgttcgtgact

SEQ ID NO: 38358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttgacggaggcctgtttcggacgacgtgt

SEQ ID NO: 38359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttgagactctaattgtgacttgatcgtaa

SEQ ID NO: 38360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttgaggccgccttgtaatgtgttcccttt

SEQ ID NO: 38361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttgatcaggtggacatgggttagccttgt

SEQ ID NO: 38362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttgatgtacgtagtaagcgttcatggcgg

SEQ ID NO: 38363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttgccaaaggtggatcaagcgcataccgg

SEQ ID NO: 38364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttgccccgatagcgtagtaataggcgttg

SEQ ID NO: 38365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttgcgccggatgcattgaggtgtagcagc

SEQ ID NO: 38366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttgctccgaattggcagcaccgacccaca

SEQ ID NO: 38367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttgctttctctactctacgctctccaatc

SEQ ID NO: 38368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttggccgcgatacgtgtgcctggcttggt

SEQ ID NO: 38369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttggggacatcgggcttttttttacgtgg

SEQ ID NO: 38370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttggggcaaggattttgtgttggggacgg

SEQ ID NO: 38371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttgggtattcgagcctctaccattgtgca

SEQ ID NO: 38372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttgggtcgcgctctggagttgtacgccta

SEQ ID NO: 38373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttggtcagttgttggacctggcacatgga

SEQ ID NO: 38374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttggtgatgggagggacttcgttggtgct

SEQ ID NO: 38375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttggtggttcgaatgcaccaaaccgccgt

SEQ ID NO: 38376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttgtaacattcatcgaatctcggcctccc

SEQ ID NO: 38377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttgtaaccgccgttccgcacgtcacttga

SEQ ID NO: 38378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttgtatactgtcggtcaactaatcataag

SEQ ID NO: 38379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttgtttatatgaactcaactcgcgcgttt

SEQ ID NO: 38380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactttaaaactttgagtacacggcttaattc

SEQ ID NO: 38381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactttacagctatgatttacaatcggaggcc

SEQ ID NO: 38382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactttagcaccccgtcgcatatcgctcgtag

SEQ ID NO: 38383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactttcagaagattaaagcatataccgcaac

SEQ ID NO: 38384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactttcatttgtcttcgcgatacgagttagg

SEQ ID NO: 38385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactttcccatcaagccctcagtttggcggga

SEQ ID NO: 38386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactttcgctaacgttggtactagttgtgtgg

SEQ ID NO: 38387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactttcgtcgtgggctagatttcggagggga

SEQ ID NO: 38388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactttctctggtgtctaatttctggtttttt

SEQ ID NO: 38389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactttctggtgagcttacctcgtcgggttct

SEQ ID NO: 38390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactttgcaatctatgtccccaaatatcacaa

SEQ ID NO: 38391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gacttttctcgggttgccgctttggcaagtta

SEQ ID NO: 38392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactttttcccgtagaatccatcataaccgta

SEQ ID NO: 38393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gactttttggggttcactgagggtagtgtgct

SEQ ID NO: 38394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaaaaggtatcatgtagcttacgggccgcg

SEQ ID NO: 38395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaaaatggacatcatggatcaggttaagcc

SEQ ID NO: 38396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaaacaccttttagtagtgtaggttgcaca

SEQ ID NO: 38397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaaacctgattcgaatgaacctgggatagc

SEQ ID NO: 38398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaaactgcctagacaatgcattatttgcac

SEQ ID NO: 38399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaaagccgagataaatggagataactaact

SEQ ID NO: 38400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaaagggcatgggggggacatagaaatact

SEQ ID NO: 38401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaaagttggttagggaatggcctccctgtg

SEQ ID NO: 38402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaaattcgtttattacttatcacggtccgg

SEQ ID NO: 38403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaacccgagtttggtcgaggctgaagccgt

SEQ ID NO: 38404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaaccgtcgtgtccgtatttctcttacaca

SEQ ID NO: 38405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaacctggcgttttaccagcttgggcgttc

SEQ ID NO: 38406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaacgaccaagggtgtaatatgcactgtag

SEQ ID NO: 38407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaacgagctgacgtcttcgcccggcgctcc

SEQ ID NO: 38408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaacgcaacggcatccctacgcccaggtat

SEQ ID NO: 38409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaacgcactgaggttagccggcgcattcgg

SEQ ID NO: 38410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaacggacacttgtgttctcggctactatc

SEQ ID NO: 38411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaacgggtcagggattttccgaagcggcga

SEQ ID NO: 38412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaactgccaacggtggtacatttgaccagg

SEQ ID NO: 38413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaacttgtgaaaagtagtaatatgcaatcc

SEQ ID NO: 38414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaagatagctaatgataacgaattgaggcc

SEQ ID NO: 38415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaagcaacctccttgctcaagatttcgttc

SEQ ID NO: 38416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaagccagcatctgagggtgacgtagcagt

SEQ ID NO: 38417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaaggaagctcgggtcgttcgtgggcgctt

SEQ ID NO: 38418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaaggcacgtccggctctactggtacagaa

SEQ ID NO: 38419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaagggcctgaacctccttcgtggtgccac

SEQ ID NO: 38420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaagggtaaacaggcccccatgccaaattc

SEQ ID NO: 38421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaaggtaaggtaaacgcacaggactgtttg

SEQ ID NO: 38422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaaggtcactacgttaggcaaccggcgtag

SEQ ID NO: 38423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaaggtgtggtagtgtgatctactgcggga

SEQ ID NO: 38424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaaggttggggtgccgctcataaagggcct

SEQ ID NO: 38425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaagtaatatgaaggtggaagattgttagt

SEQ ID NO: 38426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaagtacgttctctccggacactgcccacg

SEQ ID NO: 38427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaagtgaaacaaatggctttaaaagcgcgc

SEQ ID NO: 38428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaagtgccggaatgagatcatccgccgcgc

SEQ ID NO: 38429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaagttcgctgagctgcaggttcgtcgtca

SEQ ID NO: 38430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaagttgactggcagctttgaggttgtaca

SEQ ID NO: 38431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaataagagcagggcgatctaccgcgtacc

SEQ ID NO: 38432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaatacgttggcgcctgatagagttaaaga

SEQ ID NO: 38433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaatagatcactccattgatcctgtatgcg

SEQ ID NO: 38434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaatataaagatgatgaagctgccatcctc

SEQ ID NO: 38435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaatatcgttttgattggactaattatact

SEQ ID NO: 38436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaatcacatgatcattccgtcttagaccat

SEQ ID NO: 38437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaatccgggtgcatagagccaacgggcttc

SEQ ID NO: 38438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaatcgaagcgcgcaagttttagtaacact

SEQ ID NO: 38439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaatcgcatgcccctacgcaacgcgctgcc

SEQ ID NO: 38440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaatctatcctatctaactcacttagtcgg

SEQ ID NO: 38441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaatctcaatgtattggcagcggagtaagt

SEQ ID NO: 38442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaatgcaggtatacttctgtgcaatacata

SEQ ID NO: 38443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaattaacaaatggaagcgtcaactaaagg

SEQ ID NO: 38444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaattatttctgaagcacgcaatctgtcgt

SEQ ID NO: 38445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaattcacaagtgcctgtcatcctggtcgc

SEQ ID NO: 38446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaattgtgggcgcataatccgcgggtggta

SEQ ID NO: 38447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacaactataattcggcggaggcacacttc

SEQ ID NO: 38448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacaagctctttatcttcttctgggtcgac

SEQ ID NO: 38449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacacggagcttccttggtcgtgtttgtcc

SEQ ID NO: 38450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacacgtgtcacttcgcgcgcctcgtaagc

SEQ ID NO: 38451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacactgtattgactcggaatttcttcgtt

SEQ ID NO: 38452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacagcctgggctatgctcgtctgcgcaat

SEQ ID NO: 38453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacaggcactgaaggttaagcgcagcgtcc

SEQ ID NO: 38454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacattcttgttgctaggctgaccgcatcg

SEQ ID NO: 38455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaccagggtaccggactacttgcgaccgtg

SEQ ID NO: 38456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaccagtagggaggtggtcaggttcctggt

SEQ ID NO: 38457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaccagtgggcacttacttgtatgcctagt

SEQ ID NO: 38458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaccccgaagcattacggtgtcatgtccgg

SEQ ID NO: 38459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaccccgcgagggcggcaagtcccgatccc

SEQ ID NO: 38460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacccgagaggccgctgctctttgtcactc

SEQ ID NO: 38461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacccgcattctgacgcaggatgtcggttc

SEQ ID NO: 38462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacccgggagcgacaccaatctacggtaca

SEQ ID NO: 38463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaccgaggcgccgcgtgaaggagtgatgtt

SEQ ID NO: 38464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaccgagggcagcacaagcacgtggacatg

SEQ ID NO: 38465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaccgggaatccataaatcctctcgcacga

SEQ ID NO: 38466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaccgttgtttacccttcacatgtgcggga

SEQ ID NO: 38467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacctagcttagaataccagtgtatgggta

SEQ ID NO: 38468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacctcgcattccttttgatttaactgcgg

SEQ ID NO: 38469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacctcgcttgtcacttgccgctcatccta

SEQ ID NO: 38470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacctgacactcgcggtgtcgttttttgga

SEQ ID NO: 38471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacctggacagtgacaatgtggactaagca

SEQ ID NO: 38472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacctggagggagactcgttgcgtcatctg

SEQ ID NO: 38473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaccttcggcttgccagcgatattctcagt

SEQ ID NO: 38474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacgacactcgtgtatccccctattggctt

SEQ ID NO: 38475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacgacgcagagctgttggggcaaacgtag

SEQ ID NO: 38476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacgaggtcgttccttaagacgtggagatg

SEQ ID NO: 38477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacgattctaacgagcgcgtcaattttcca

SEQ ID NO: 38478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacgcacaacgtttgagctcaaccaggcgc

SEQ ID NO: 38479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacgcagaccggtcttgcactcatgccgct

SEQ ID NO: 38480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacgcctcggttcgacatggtgagcgccgc

SEQ ID NO: 38481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacgcggcttaatcagactcaatgtgggcc

SEQ ID NO: 38482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacgctacagtaggacgcggtatggctggg

SEQ ID NO: 38483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacggcagaggcgcactcccatgcgggcta

SEQ ID NO: 38484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacggcggctgtagaccttttgcccgacgt

SEQ ID NO: 38485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacggcttacgacagactcttcggctttgc

SEQ ID NO: 38486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacgggacagggtcggggtgatgggcccgg

SEQ ID NO: 38487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacggggagagataatatgttaccgggggc

SEQ ID NO: 38488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacggggcctctgcgaaggtagtggtatga

SEQ ID NO: 38489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacggggggaacggctcctcacgcattgag

SEQ ID NO: 38490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacgtccccgcgtataacacgtcggagtgg

SEQ ID NO: 38491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacgtcccggacggtgaggtggtgccacgg

SEQ ID NO: 38492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacgtgccagtggatgacggtatgtggagt

SEQ ID NO: 38493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagactaacagcatgctggcaatcggtcgtcg

SEQ ID NO: 38494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagactactgaatggggggaaatactcggcct

SEQ ID NO: 38495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagactcttggcctaagggtggttcgtaactg

SEQ ID NO: 38496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagactgacgggccgattagatgctttatcct

SEQ ID NO: 38497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagactggcagggaggcggtcagcgtggttat

SEQ ID NO: 38498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagactggccaatcatgggccttagcctttac

SEQ ID NO: 38499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagactggctttaatagttggggtggttccgt

SEQ ID NO: 38500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagactgtaccgtgtcccactgctctacaccg

SEQ ID NO: 38501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagacttcgttacgccggggctcacttagcgg

SEQ ID NO: 38502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagaaactcaatggatgtagggcggcgttc

SEQ ID NO: 38503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagaatctttcaatgggtacttgttaatat

SEQ ID NO: 38504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagacaccttattcggacccgcttgtgatg

SEQ ID NO: 38505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagacatgctgaacttgcgcttgcgcatca

SEQ ID NO: 38506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagacggattgcgcgcacatgattctcctc

SEQ ID NO: 38507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagacggttacgcacatgaggtccgtcccg

SEQ ID NO: 38508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagacgtctgccgggcgcctgagatactta

SEQ ID NO: 38509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagatagaagtcgccgcgcggagtggtgca

SEQ ID NO: 38510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagatcgttagcaatgcgagatcgtgaact

SEQ ID NO: 38511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagattacttcaagggttatgaatccttat

SEQ ID NO: 38512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagatttattagcagagtttaaattaaagt

SEQ ID NO: 38513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagcaagcattagggcgaaccgtgggtacc

SEQ ID NO: 38514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagcacgtccataccgcggaagtcttacgt

SEQ ID NO: 38515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagcaggagtgtactgatggtattttgcgg

SEQ ID NO: 38516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagcagtcgtgcttgagtccgaagcttgat

SEQ ID NO: 38517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagccatcgacgcggtgctaggctggcatt

SEQ ID NO: 38518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagcgaatttgaacggctagcgttgtttct

SEQ ID NO: 38519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagcggcggcgagtctgaggcaacttgcgc

SEQ ID NO: 38520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagcgggagcatcgtaggatcagtttctgt

SEQ ID NO: 38521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagcgggtaccgatttatcggacatcgggc

SEQ ID NO: 38522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagctcacggcgtaatcggtcagcgggccg

SEQ ID NO: 38523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagctgactgtttgtttttctttcctgttt

SEQ ID NO: 38524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagctttagggatagcccgcctttgtattc

SEQ ID NO: 38525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaggaagcggttatcagtatcgcctagtgt

SEQ ID NO: 38526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaggaggatcaatcgtgtgaaatgctccgg

SEQ ID NO: 38527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaggatagtacgagggcattttacagtccg

SEQ ID NO: 38528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaggatgtgcactttccgaccccagcatgg

SEQ ID NO: 38529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaggcaacaaaccccaacaaccgcatcagc

SEQ ID NO: 38530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaggccgatctgtgttgtcatggttaggct

SEQ ID NO: 38531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaggcgctgcccgaataagttgtttagttt

SEQ ID NO: 38532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaggcgtatcggaagcgagtgttcgggggc

SEQ ID NO: 38533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaggcgtttgccggaaagatttagattccg

SEQ ID NO: 38534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaggctaagtagcttaacatggagttacaa

SEQ ID NO: 38535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaggctcggcttagaattaaaatgggcccg

SEQ ID NO: 38536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagggaagggggcgctgacagcatcttgcg

SEQ ID NO: 38537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagggagcacggtacaataaactgtcatgg

SEQ ID NO: 38538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagggcctatggactcagggtcgagtgtgc

SEQ ID NO: 38539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagggcgcgatatgagctttctcggagcgt

SEQ ID NO: 38540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaggggcgaatggtggggctagggaccccg

SEQ ID NO: 38541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaggggtgtttaggcgtaggctgatgaagt

SEQ ID NO: 38542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagggtcatgtacataaaggctgagtcggc

SEQ ID NO: 38543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagggttcatgcgtggatcgctttacaatg

SEQ ID NO: 38544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaggtgagcgtactgtaccaggtttaggga

SEQ ID NO: 38545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaggtgaggacacaggatcccgcgagtaag

SEQ ID NO: 38546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaggtgcgagggaccactcgacaggcggtg

SEQ ID NO: 38547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaggtgtatggaagtaggattataaacgag

SEQ ID NO: 38548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagaggttgggacgggctggcattgcggagtg

SEQ ID NO: 38549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagtagcatttgtgttgggtttgttaaacc

SEQ ID NO: 38550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagtatacggcatagtcgtgcgcatcctgt

SEQ ID NO: 38551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagtcaactgtccataggtccggaagttgg

SEQ ID NO: 38552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagtcacggtcgttcgtttatgttgcattc

SEQ ID NO: 38553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagtcctgaagtgaatctaagcgccgtgtt

SEQ ID NO: 38554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagtctatggagcaggaaaggatagttggc

SEQ ID NO: 38555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagtctccgctcgatgtggcaaggatatat

SEQ ID NO: 38556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagtctggctcttggggtcgtgatcgcctc

SEQ ID NO: 38557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagtggtacgttgggagacgattcatgtgc

SEQ ID NO: 38558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagtggtccgttaggagtcataggatgggc

SEQ ID NO: 38559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagtgtgtactggatgcagtattcctccta

SEQ ID NO: 38560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagagtgtgttagcctcgcagcgctcgtttgg

SEQ ID NO: 38561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagataaaggtatcgtaccccgagtagagcct

SEQ ID NO: 38562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagataacacttatccctggtgcgcgtcgctc

SEQ ID NO: 38563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagataagatgtcctggggccagtatccataa

SEQ ID NO: 38564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagataattatcccacctttactatgataact

SEQ ID NO: 38565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatacaatagctcgctacatcctgtgactg

SEQ ID NO: 38566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatacaggacttccgagttatactaatcac

SEQ ID NO: 38567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatacaggtgaaggttgccggtagcgtgtc

SEQ ID NO: 38568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagataccttgtctagcgtttaggtagcgggc

SEQ ID NO: 38569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatacgtgagtctccaacgccctggctgcg

SEQ ID NO: 38570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatatccggtttcctctttatatcctcgac

SEQ ID NO: 38571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatcaccgggttgcagactcataggggtat

SEQ ID NO: 38572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatcatcgtttcaaccctcagcgtcgtttt

SEQ ID NO: 38573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatcatgtctagggtgttgctgatgcgagt

SEQ ID NO: 38574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatcgatatacttattaaactccttccctg

SEQ ID NO: 38575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatcgcggcattggtgcgaggtgaatgttt

SEQ ID NO: 38576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatcgggagaagtttctgtcattgcggctc

SEQ ID NO: 38577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatcgggctgaagaggtacttgcatttcga

SEQ ID NO: 38578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatcgggtcgcaggctccatggactcaatg

SEQ ID NO: 38579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatctatacgggtggttgtgaagacctgtt

SEQ ID NO: 38580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgaactgacctaggagatctttgaatgg

SEQ ID NO: 38581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgagcatcaaggatcgacgggggatgcg

SEQ ID NO: 38582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgaggtctggggctctgtagtatgtgtc

SEQ ID NO: 38583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgatccgtcctcgccgtagttcggacat

SEQ ID NO: 38584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgatggtgacctattacgtatcgccgaa

SEQ ID NO: 38585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgattgatgcttttgctagacgccgctt

SEQ ID NO: 38586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgattgattcgagactgcacgtgtattc

SEQ ID NO: 38587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgcatagattactgacctgtgattgcac

SEQ ID NO: 38588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgccaagggtggttcccccggcaactgg

SEQ ID NO: 38589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgcccagccgtaccgacgccggttactt

SEQ ID NO: 38590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgccgtgccctgcatagcgtacttaatc

SEQ ID NO: 38591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgcgatggttaccgtcggcgtgggcccg

SEQ ID NO: 38592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgcgcggtggacgctaaagcggcatttc

SEQ ID NO: 38593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgcttaacgcgccaatgcacggaacgct

SEQ ID NO: 38594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgcttgtaatcgtgtgggtgactctgag

SEQ ID NO: 38595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatggtgcgtctgaggaatgcgttttggcc

SEQ ID NO: 38596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgtcccggtggacaaacgatggcacgtt

SEQ ID NO: 38597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgtcggtagctatcaccgagtcggatgg

SEQ ID NO: 38598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgtgacttacattagattgcggtccgtt

SEQ ID NO: 38599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagatgtgtccgcggtgttggctatttcggca

SEQ ID NO: 38600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagattacatgcaaggggtgtgatttaggagg

SEQ ID NO: 38601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagattacggcagttatgttttcgatgtcgac

SEQ ID NO: 38602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagattattcgcctctgcaagcttgatgaaac

SEQ ID NO: 38603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagattcacggtgccttctggttgcgccgcgg

SEQ ID NO: 38604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagattcgactttccggcatttatggaactgg

SEQ ID NO: 38605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagattctgtggcatcagtatagagtaacatc

SEQ ID NO: 38606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagattggatcagcacggggttggtggtggcg

SEQ ID NO: 38607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagattgggagggaaccatcgcctgtccttga

SEQ ID NO: 38608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagattgggattcgactagtgctaacttacat

SEQ ID NO: 38609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagattgtaagggtcccgcctcatgcatctcg

SEQ ID NO: 38610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagattgtaccgtaatgtgataccggcaaccc

SEQ ID NO: 38611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagattgtgcatcggccgtcctcgcagtcaca

SEQ ID NO: 38612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaaaagcgcgttccccatatcggctcgct

SEQ ID NO: 38613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaaaagggttttagtattagtctcggtgg

SEQ ID NO: 38614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaaagttgtatcgcttcccctttaacttt

SEQ ID NO: 38615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaaattaatgaagagttaaccaataatat

SEQ ID NO: 38616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaacacccgtgggttgtgaacgattaaca

SEQ ID NO: 38617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaacagcgtgagtgtgggccttgctcgtc

SEQ ID NO: 38618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaaccgagggcctgaccgggcatgttcga

SEQ ID NO: 38619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaacgaaggaagtgggtcctttcacaccc

SEQ ID NO: 38620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaacgagcgacgcaaaccggacgtacggc

SEQ ID NO: 38621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaacggaagtccgtccgtaatggatctca

SEQ ID NO: 38622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaacggctaatgcttaacacgcgtggggg

SEQ ID NO: 38623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaagagaaactgaacggctaaacctaaga

SEQ ID NO: 38624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaagagaacgcccgatgtcctataagaat

SEQ ID NO: 38625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaagagtcgatgctggtccgttgcggttg

SEQ ID NO: 38626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaagatcgtgtggttaatatccccgttcg

SEQ ID NO: 38627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaagcagtaggggatacaagtcgcgccga

SEQ ID NO: 38628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaagccacagactcaacgctgttatgttt

SEQ ID NO: 38629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaagcccggatagaatcataaccgggaat

SEQ ID NO: 38630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaaggtgtacgcgcgttatcccgagcgag

SEQ ID NO: 38631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaatccatcattttgttacagcattatat

SEQ ID NO: 38632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaatcgctgcaacgcgagacccaggccaa

SEQ ID NO: 38633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaatgctatcagaggggttggtttagtcg

SEQ ID NO: 38634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcacacgtacacctcccccgcgcactcccg

SEQ ID NO: 38635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcacacttggaaccggcctctgccccttgg

SEQ ID NO: 38636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcacagcacaaaagcacgcgaacagttcac

SEQ ID NO: 38637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcacagtccgtccattgtgatacggccatg

SEQ ID NO: 38638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcacagtgggaagacttctagcacgttgct

SEQ ID NO: 38639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcacagtttaagcactggggatctgcgcgg

SEQ ID NO: 38640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcacatctacggtattgataatgttgacat

SEQ ID NO: 38641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcacatctacgtatcattccgttccgtagg

SEQ ID NO: 38642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaccacgattacaagcgctagctctgtcg

SEQ ID NO: 38643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcacccggactgagcgtgttcggcacagcg

SEQ ID NO: 38644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaccggacttggggcctatctcgtacttc

SEQ ID NO: 38645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcacgagttatgtttgctggtttgacactg

SEQ ID NO: 38646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcacgcacgcttattattaggctacggagc

SEQ ID NO: 38647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcacgccggcacagcgggttcaggtaatac

SEQ ID NO: 38648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcacggatcccaacgtcacttctcgtggcg

SEQ ID NO: 38649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcacggtaggggattgacaacatgatccac

SEQ ID NO: 38650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcactcatagaagttaagcattgtttgcgt

SEQ ID NO: 38651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcactcgggactacggcgtgccggatccat

SEQ ID NO: 38652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcactgtctcggagcgcctggtcacccaag

SEQ ID NO: 38653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcacttagcatagtttcccttttccagtgt

SEQ ID NO: 38654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcactttgggggcggagtgaggtcatgcgc

SEQ ID NO: 38655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcagacccgcgttttttagaccatgacccc

SEQ ID NO: 38656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcagaggtgcaagtttcgcgctccgtccac

SEQ ID NO: 38657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcagagtaagctatattgaagcgtccttga

SEQ ID NO: 38658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcagatgatatgcgcactatacctttttgg

SEQ ID NO: 38659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcagcctacgcgttctccgttactgcctcc

SEQ ID NO: 38660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcagccttaagcggtcggttacgttacgga

SEQ ID NO: 38661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcagcgataacacctaaaaggctcaatcgt

SEQ ID NO: 38662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcagggccacacgatgtttagacgaacggg

SEQ ID NO: 38663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcaggggtgcgatgaattgcatccttgcgg

SEQ ID NO: 38664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcagggtaccctggtccgtgcaccggatgg

SEQ ID NO: 38665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcagtgcacgaactaaattgcgctggggtg

SEQ ID NO: 38666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcagtggtcacaccggtgcctaaggcgata

SEQ ID NO: 38667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcagttggcccccactcagcgggttttccc

SEQ ID NO: 38668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcagtttaccatctgaatctaccgaggggt

SEQ ID NO: 38669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcataaagcggctacaggcggagatcagcg

SEQ ID NO: 38670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatagcagatcggtcggtctcttaccgct

SEQ ID NO: 38671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatagctcattgttttatatagtacattt

SEQ ID NO: 38672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatagtagctgcacacaccgatcaggctc

SEQ ID NO: 38673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatatagctcgcacggctgatccggttgt

SEQ ID NO: 38674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatcaggaggaccatgactgctgtgtccc

SEQ ID NO: 38675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatcctgcagttgggagaagagctgacct

SEQ ID NO: 38676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatcgctgcggatcagagcatgatagtgc

SEQ ID NO: 38677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatcggtgagccgcacaccactattcctg

SEQ ID NO: 38678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatctacttcccggtccccagggtgtgtt

SEQ ID NO: 38679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatcttcacggtgtgtgcagcgatctggc

SEQ ID NO: 38680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatcttcctgcaggaaggacccgcttgca

SEQ ID NO: 38681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatgcggcgaaaatccagatttcccgttg

SEQ ID NO: 38682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatgcttagggtaccgcacaggggatatt

SEQ ID NO: 38683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatggcctttcacgtgatgggtagtcacc

SEQ ID NO: 38684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatggcgtggtgagtttggctatggttcg

SEQ ID NO: 38685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatggctaggattcctcgagggagaacgt

SEQ ID NO: 38686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatggctgtatcgcggagtagggaggttt

SEQ ID NO: 38687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatgggaccgaggttttgactttccgcaa

SEQ ID NO: 38688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatggtgggtagatccagttttgcgctcg

SEQ ID NO: 38689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatttatcttatagttcgggagctaagga

SEQ ID NO: 38690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcatttggaggcctagcgcagttcctggaa

SEQ ID NO: 38691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccaactagctactgcacgcggagtacatt

SEQ ID NO: 38692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccaatcagactattttggagatccacgtc

SEQ ID NO: 38693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccaatggcctgtcacgttgttcgccgttt

SEQ ID NO: 38694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccacaagaccgtcgccctggccagtaact

SEQ ID NO: 38695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccacattttcagggtaacattgggaacgt

SEQ ID NO: 38696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccaccaacgtcagggtgtcttcgttcgcg

SEQ ID NO: 38697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccacgggggcaatcttcaccctcggtttg

SEQ ID NO: 38698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccacttggagggtaagccgtcagcacccc

SEQ ID NO: 38699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccagaccaaagtgcttatatcaagctaac

SEQ ID NO: 38700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccagcaaaagggatgtcgaatcacggtct

SEQ ID NO: 38701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccagcttaggggggtgttagttgacgagg

SEQ ID NO: 38702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccaggggcatcattacgaccacgggctgt

SEQ ID NO: 38703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccagttgttttcgtgccaacatgctgacc

SEQ ID NO: 38704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccatgcacgcatttcaggtggaagaactg

SEQ ID NO: 38705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccattacagtctgtcccttgtcttgctgt

SEQ ID NO: 38706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcccacaaggtaggagcgtcgcgctggtcg

SEQ ID NO: 38707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcccacattcggagttcggctaaagctagt

SEQ ID NO: 38708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcccagggggaatgtgagggccaacttagc

SEQ ID NO: 38709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcccagtgcaggaaggtcatcgggtggaac

SEQ ID NO: 38710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccccacgtttatggcatgaattcggctag

SEQ ID NO: 38711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccccgagcgaaggaggatttctcgtctca

SEQ ID NO: 38712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcccgaatggcgcgtagggagatgccggcc

SEQ ID NO: 38713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcccgacatgttctccggcatcctctcgtc

SEQ ID NO: 38714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcccgagctgtactaggaatcggctaggat

SEQ ID NO: 38715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcccggcgggagttgaccgtgtagatgcct

SEQ ID NO: 38716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcccgtagctatcgcgatcccgtctgagtg

SEQ ID NO: 38717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccctacgtctggtcactcagggggctttg

SEQ ID NO: 38718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccctcgctgtgtttcaaggctaatgaggt

SEQ ID NO: 38719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccctcgggtacctccggcgtgcaggcggt

SEQ ID NO: 38720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccctctggccgccttatgtcgagtttgac

SEQ ID NO: 38721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccgaggttggttcttgttatcggcattaa

SEQ ID NO: 38722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccgataatagggcgaggatggtagccgaa

SEQ ID NO: 38723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccgcaattctgaatcggtgcgaagcgtgc

SEQ ID NO: 38724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccgcccacacggggttcgttcaagattca

SEQ ID NO: 38725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccgccgtttggatcgacgtgactcggtct

SEQ ID NO: 38726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccgcgggccacgaggctgcttactgcttg

SEQ ID NO: 38727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccgcggtgcccatctctgtggactgatag

SEQ ID NO: 38728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccgcgtaagcattacacacgatttgttcg

SEQ ID NO: 38729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccgcgtcgttggagtcgtatccctgcgga

SEQ ID NO: 38730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccggcgccgtaaccgtagagatcggtcgc

SEQ ID NO: 38731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccgggactggaacgttgaggtcgtcacta

SEQ ID NO: 38732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccgggccctttgcgactttggtgatggtg

SEQ ID NO: 38733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccggtaagtgagggatagtgtcctccgtg

SEQ ID NO: 38734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccggtacagcgataacgccacctggggag

SEQ ID NO: 38735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccggtatttggccggaaaaaccaacagca

SEQ ID NO: 38736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccggtgaatcggacaagtgcggcggcggg

SEQ ID NO: 38737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccggtgaatttatcgttcattgtggttta

SEQ ID NO: 38738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccggtggggcgcatgttccttcctgaata

SEQ ID NO: 38739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccgtgggtgacgttggtcatttgagcctg

SEQ ID NO: 38740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcctaacccgccccgccgcactaaggttcc

SEQ ID NO: 38741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcctacaattcaacttgcgagacatcgggc

SEQ ID NO: 38742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcctagagatgaatacccgttactgatatg

SEQ ID NO: 38743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcctatccagtgccgcagctaacaacccgc

SEQ ID NO: 38744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcctatgttccgcgataatcctttctgtgc

SEQ ID NO: 38745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcctccaattcacaacggccgatcagcgtt

SEQ ID NO: 38746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcctcgtttgaccctagcgcctcgttactg

SEQ ID NO: 38747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcctcttcttacgcagatcaacgtcgcgcg

SEQ ID NO: 38748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcctgaggggcgtagcttatcggctaggag

SEQ ID NO: 38749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcctgattcgcgggacgcgttaggccgttg

SEQ ID NO: 38750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcctgcctttttggccgactaaagtacctt

SEQ ID NO: 38751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcctggtcgttctcatatgtgttattgtgc

SEQ ID NO: 38752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcctggttaccgttccccggaccggcctag

SEQ ID NO: 38753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcctggttgacaggtgtctggtttaagacc

SEQ ID NO: 38754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccttatccagttatgctcatgggttgtag

SEQ ID NO: 38755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccttgctcgccaatgagacggccacaggg

SEQ ID NO: 38756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagccttggggcaatgacggccagctggcctg

SEQ ID NO: 38757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgaacaaggaacgcctacagttccctgaa

SEQ ID NO: 38758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgaacatagggctcgggaccgcacgctcg

SEQ ID NO: 38759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgaacggtgttcaatcgcctgtgtatatg

SEQ ID NO: 38760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgaagatgtccaggcggtcctcgcatctc

SEQ ID NO: 38761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgaaggaaggcgattggacgcgtacctgt

SEQ ID NO: 38762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgaagtacgtctcctatggcagatggtaa

SEQ ID NO: 38763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgaatggcgaggctcagctctaggcctga

SEQ ID NO: 38764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgacatatatgcagttctagcatattggc

SEQ ID NO: 38765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgaccagggcacccatgaagactgataac

SEQ ID NO: 38766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgacgagacgtccagcacatcgacggtgc

SEQ ID NO: 38767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgacgcaatcgtcctcgacgtattctgtt

SEQ ID NO: 38768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgacgccgtaatcactggactcatttcac

SEQ ID NO: 38769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgacggcatagggggcccagtcagtggtc

SEQ ID NO: 38770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgacgggagcgtgggtgaatcagggtgtc

SEQ ID NO: 38771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgactgggcaacaacgcacaagcatgggt

SEQ ID NO: 38772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgagataacgccatgattgcgattccccg

SEQ ID NO: 38773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgagccgatatcgtatcaaagtggatgta

SEQ ID NO: 38774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgagtggcatgtttgtctgtcctgtacgt

SEQ ID NO: 38775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgagttagtctggtcgtaagagatcattg

SEQ ID NO: 38776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgatcagtgatttaggcactatggatgtg

SEQ ID NO: 38777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgatccgacctttcgcggggctgggcgag

SEQ ID NO: 38778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgatggaccggactagggcagtgtggttt

SEQ ID NO: 38779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcaagagcaccgtacaagaggcgtcccg

SEQ ID NO: 38780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcaaggcgggcttgcggtatcgggggtg

SEQ ID NO: 38781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcacgaacgagcaagttcaaaacgctcg

SEQ ID NO: 38782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcacgactgaatggaccaccacaattca

SEQ ID NO: 38783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcactagttccctgctaattttaccact

SEQ ID NO: 38784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcagcggctgcatagtcaactatcctcc

SEQ ID NO: 38785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcaggacgcctgagagtcggtgacttgc

SEQ ID NO: 38786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcatacggatattcctcatcgtctttgg

SEQ ID NO: 38787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgccacccaacgacatgcaggccgcggag

SEQ ID NO: 38788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgccatctcggccgtgcacaactgcctgc

SEQ ID NO: 38789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcccaccctcgttgcgttactgacgacg

SEQ ID NO: 38790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcctcttattctggcttgtgcgttgctg

SEQ ID NO: 38791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcgatctgggcttcgtccttccggccta

SEQ ID NO: 38792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcgcatccaatgccggagtcaatgtgcc

SEQ ID NO: 38793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcgcccagtgaacgatcgtgttcaagtc

SEQ ID NO: 38794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcgcgcggagggacgagtgtagaggggg

SEQ ID NO: 38795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcggacctgagtacatctttctgacgaa

SEQ ID NO: 38796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcggtgcaggtcggtttcctctcgcgtt

SEQ ID NO: 38797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcgtgccagagcctgcatcatggatggc

SEQ ID NO: 38798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgctacccccagaacatgaactcgggtgc

SEQ ID NO: 38799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgctagttggtacctagctgacacggata

SEQ ID NO: 38800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgctctactgctctgggcgaatccgtact

SEQ ID NO: 38801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcttacttccagtgactgtatgtagtac

SEQ ID NO: 38802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgcttcatgaattttaatacagcgaggca

SEQ ID NO: 38803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggacccaagaagagacgcggcaagggct

SEQ ID NO: 38804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggaggatgacatgtgatggtgtcttgca

SEQ ID NO: 38805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggatgcaatcgcccatgggcattgatct

SEQ ID NO: 38806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggatttcaaaagaaaggttcctccgaaa

SEQ ID NO: 38807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggcaagcggatagcgagacaattatcgc

SEQ ID NO: 38808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggcagggaggttctactagttcggcttg

SEQ ID NO: 38809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggcccagaacgcgcagatggacacgtcg

SEQ ID NO: 38810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggcctccgtttgattcagctgctaatgg

SEQ ID NO: 38811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggcgcggagttcgcaggtacgtttgggt

SEQ ID NO: 38812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggcgtcaatggcaaggcgaccctatgtt

SEQ ID NO: 38813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggcgtcgcggtactgtagaagtgacagc

SEQ ID NO: 38814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggcgtgagttgcagtcgaccctgtgtgg

SEQ ID NO: 38815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgggacgaactcactactcgctgtaccac

SEQ ID NO: 38816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgggagaagtgagacacggttcgaaacca

SEQ ID NO: 38817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgggagttcatccccgagctgtctcaagt

SEQ ID NO: 38818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgggatattcgtaagcgaacacgaaggtt

SEQ ID NO: 38819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgggatccctgagcggttgaaaactcttg

SEQ ID NO: 38820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgggcgcccggtgtctggggcgattcggg

SEQ ID NO: 38821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgggcttgaagctcaagcggcaggcagcg

SEQ ID NO: 38822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggggcacttcaagctcaatgtgcggtca

SEQ ID NO: 38823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggggctgttagcgaatgtgtccgcgagt

SEQ ID NO: 38824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgggggcacgatgcaagtaccggtcgagt

SEQ ID NO: 38825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgggtaaaccggatcagcaaagcggtctc

SEQ ID NO: 38826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgggtcgtactgccgtaagctagtgagag

SEQ ID NO: 38827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgggttccagtgtaaaatgctctttggta

SEQ ID NO: 38828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggtagcatcacctggatcatgcgtgctg

SEQ ID NO: 38829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggtatcgttattgacctctgcacggtag

SEQ ID NO: 38830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggtcactctgcggtcgtgggtgaggtac

SEQ ID NO: 38831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggtcactggattgggaaagcatcaggtt

SEQ ID NO: 38832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggtgtattatgaggcggggtgctttatc

SEQ ID NO: 38833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggttacgagacggcattgtactggtgac

SEQ ID NO: 38834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggttcaggatgttgtctcgattctgtcc

SEQ ID NO: 38835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcggttcgggtagcgccgtgctggttgtcc

SEQ ID NO: 38836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgtaaacactcagcttttcagattaaccg

SEQ ID NO: 38837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgtaaggcgggtttttgcctagtgcgagg

SEQ ID NO: 38838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgtaccacctaacccttcggcgtcgcggg

SEQ ID NO: 38839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgtactataattctcgaataggaggagct

SEQ ID NO: 38840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgtagtctgcgtatctgtgcatgtcagca

SEQ ID NO: 38841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgtatcgtatcagcggagtcgggaggctg

SEQ ID NO: 38842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgtattagcttggttataggccaatggaa

SEQ ID NO: 38843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgtcaatcatacgaagcagagcatttgtg

SEQ ID NO: 38844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgtccggactgcagatggatctaacgagt

SEQ ID NO: 38845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgtctaagatatggggaaaggcaaaataa

SEQ ID NO: 38846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgtgaccttaccgacacattcgttgaggg

SEQ ID NO: 38847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgtgccatccccggctgaggagtgagccg

SEQ ID NO: 38848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgtgctcagtattcggacgcttgagggtg

SEQ ID NO: 38849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgtgggactgtgatgtcttgtaccctatc

SEQ ID NO: 38850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgtggtcgtacccctcacactctctttgg

SEQ ID NO: 38851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgtggtggcggagagaatgcgaggtatgt

SEQ ID NO: 38852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgtggttgagaatgatgatccgatgtccc

SEQ ID NO: 38853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgttaatagtaactggattagccgcctac

SEQ ID NO: 38854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgttggagggagtcagacggcttgggggc

SEQ ID NO: 38855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcgttgggctatgtctcgggtcattcggga

SEQ ID NO: 38856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctaaagacatagccagaccacgtagcagc

SEQ ID NO: 38857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctaatcctctttgaacgatggtcattctc

SEQ ID NO: 38858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctacagataacttcacccactcgcgctac

SEQ ID NO: 38859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctacccaagcacatttggcgccaagcact

SEQ ID NO: 38860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctaccgcgacaggcgccagcatgtggcaa

SEQ ID NO: 38861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctaccgtggatggttctagggtctgaaac

SEQ ID NO: 38862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctactccgtcgggtcgtaaaaagcgcacg

SEQ ID NO: 38863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctagattcggctccccatagcctatccgt

SEQ ID NO: 38864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctagttttcgtgtgtacctatgttgcttt

SEQ ID NO: 38865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctatgaagggctccggttgcgttagtgcg

SEQ ID NO: 38866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctcaatgaagcgcactgagttttccgttt

SEQ ID NO: 38867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctcagtccgcgctgcgatgccgcgttacc

SEQ ID NO: 38868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctcatgtggtatgcttaggtcttggcgtc

SEQ ID NO: 38869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctcattcaggacacggagctggtcacgca

SEQ ID NO: 38870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctccaccgcactgcataatgtacaggcct

SEQ ID NO: 38871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctccagtttcggggacggagacgagtaac

SEQ ID NO: 38872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctcctcgtcacccctgatcgtcgtaccat

SEQ ID NO: 38873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctcctgcccaaccgtgtcagctagcttcc

SEQ ID NO: 38874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctcgacatacacggatctacggctctttg

SEQ ID NO: 38875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctcgagggtagcttccttttccgcgcgta

SEQ ID NO: 38876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctcggccccgggtctccttagcggcctag

SEQ ID NO: 38877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctgaattgtggagaaaattgcgtgctccg

SEQ ID NO: 38878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctgacctactacatgatgtccacgggcct

SEQ ID NO: 38879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctgagctccggcaagctcgaaagagtcct

SEQ ID NO: 38880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctgaggaatacgtccgacccagtggacta

SEQ ID NO: 38881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctgattcagtaacggtgctcggtccgcgc

SEQ ID NO: 38882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctgattggatgtacgcctctaccgggcta

SEQ ID NO: 38883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctgcaccgcgtgctggcctactgtctttg

SEQ ID NO: 38884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctgccgacgcttggaagtaccaacggata

SEQ ID NO: 38885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctgccgcggggtttcaatttataccactc

SEQ ID NO: 38886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctgctctgaataaacacgtcgaggggtgt

SEQ ID NO: 38887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctgcttgaaggagtccgtttcacttattc

SEQ ID NO: 38888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctggaatcgttcgcaaaagccaggcgtaa

SEQ ID NO: 38889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctggtaagatggcgtgctggttcactttc

SEQ ID NO: 38890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctgtcgaggcgcttgtaatctattccgtg

SEQ ID NO: 38891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctgtgcattttccatctgccacgatcgtt

SEQ ID NO: 38892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctgtgctgatgccaagtcaaagcttggcc

SEQ ID NO: 38893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctgttcacgaagccaattgctgctggagc

SEQ ID NO: 38894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctgttttaaggaacggagtctagaggtta

SEQ ID NO: 38895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcttagcacctactggggattgctttgctg

SEQ ID NO: 38896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcttaggtaccacgtccaaacaatgcgcga

SEQ ID NO: 38897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcttcaccacaccgcggtctcgtcctttgt

SEQ ID NO: 38898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcttcccataaacatcaatatgcatttgtg

SEQ ID NO: 38899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcttcggatataatcgataccgacggcaag

SEQ ID NO: 38900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcttcgtaattggcgagcggtcaacattcg

SEQ ID NO: 38901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcttgagatacatgtgtgaacgatcgcgat

SEQ ID NO: 38902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcttggaagggattcggccaaactgaccaa

SEQ ID NO: 38903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagctttcccggctttgtttgctggtggggcg

SEQ ID NO: 38904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagcttttgtatccctccaaccacttcgcgtg

SEQ ID NO: 38905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaaacgctatgagctaacgtacctccgga

SEQ ID NO: 38906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaaacgtcagagcgtgtagaatatacggc

SEQ ID NO: 38907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaaagactagcccgtcactctcgcgctcc

SEQ ID NO: 38908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaaattgtcccccagtagacgctttcgag

SEQ ID NO: 38909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaacatctacgtcgttgcatattgttgtg

SEQ ID NO: 38910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaaccgggtctttatgttttcaatccatc

SEQ ID NO: 38911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaactgcacgccaatgtaggctgaggagg

SEQ ID NO: 38912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaagacgtctggcagagtgcaccgccggt

SEQ ID NO: 38913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaaggccggagctccatattacggtgcgg

SEQ ID NO: 38914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaaggcgttctcctgtcatgtcacttccc

SEQ ID NO: 38915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaaggtaagggcggcgctcggcctgttcc

SEQ ID NO: 38916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaaggtggctgaagtctaggtcgctggct

SEQ ID NO: 38917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaatctgtgtatgtggggggaggcgtttc

SEQ ID NO: 38918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaatggagaggtttaccaagtgcgtggga

SEQ ID NO: 38919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaattcctggctgatctcggtcatcatga

SEQ ID NO: 38920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaattggaaacgggttacagatacatagc

SEQ ID NO: 38921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggacacagcccctctgtggaggatgtgggg

SEQ ID NO: 38922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggacacgatagcagaattgccttggccagg

SEQ ID NO: 38923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggacagacattgttttcaagtcaccgagtg

SEQ ID NO: 38924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggacagtgtcagcgggttaaaaggccttgc

SEQ ID NO: 38925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaccgcctggtatacggcaagcgtatctt

SEQ ID NO: 38926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggacctcgtcagccagccgaaagttggccc

SEQ ID NO: 38927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggacgaaccgctaacccataggagcctcct

SEQ ID NO: 38928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggacgacttgtacagccgtaaccgcttagc

SEQ ID NO: 38929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggacggaccgaaggagagtattttgcggca

SEQ ID NO: 38930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggacggccctcggttagatcgcggcgagga

SEQ ID NO: 38931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggacgtatgccggctatagtatcgtgaggt

SEQ ID NO: 38932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggacgtgtaggatcgtgtcgtaaagtggca

SEQ ID NO: 38933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggactaggcgctcagcaggatgccgacggc

SEQ ID NO: 38934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggactcggattcggttggtgggcctcctag

SEQ ID NO: 38935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggactcggtactatgtaacctatagtcgta

SEQ ID NO: 38936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggagacggtatgaggtatcgttacaaatgt

SEQ ID NO: 38937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggagaggttgggccgtaggcagtcgctgtc

SEQ ID NO: 38938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggagcagtacataacagcatatttcccggg

SEQ ID NO: 38939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggagcccgggtgcataactaaggctggggg

SEQ ID NO: 38940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggagcgcaggccaaaaagggtctgggtgta

SEQ ID NO: 38941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggagcggcaggggacaacatgaaagagcac

SEQ ID NO: 38942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggagcggccgttcagcagatctacgcgttc

SEQ ID NO: 38943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggagcggggaactccgtcggtgatgatcct

SEQ ID NO: 38944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggagcgtagcgcagtgagtctgataccgga

SEQ ID NO: 38945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggagcgttatgctcgctaggagacaggcta

SEQ ID NO: 38946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaggacggaagcgggcatgttgctgagtt

SEQ ID NO: 38947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaggacgttgacaacagacgctgtgaaat

SEQ ID NO: 38948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaggcagccttacttgtacgaaagcagtg

SEQ ID NO: 38949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaggtaacgcagccttcacctcggttagg

SEQ ID NO: 38950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaggtcaggtccacgactccctaaggctc

SEQ ID NO: 38951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaggtggatgagatattgcggatcccgga

SEQ ID NO: 38952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggaggttgttaacgattaatgtctgtttgc

SEQ ID NO: 38953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggagtagaaggttcgggctcgtgcacaagg

SEQ ID NO: 38954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggagtgcgctattcttgccgccgtgtggtt

SEQ ID NO: 38955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggatatcctatcggactgttgatttgtgct

SEQ ID NO: 38956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggatcactcgcggcactcgtccggtagcgc

SEQ ID NO: 38957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggatcggaagccgaagattatgctcggtcc

SEQ ID NO: 38958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggatgaactgaataccgttacgccaactgt

SEQ ID NO: 38959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggattaactggacatatcttacctacacac

SEQ ID NO: 38960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggattgtctctcgtgtacgatgttcggttg

SEQ ID NO: 38961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggattgttcatccgaaaatgcacctcaagc

SEQ ID NO: 38962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggatttgcattgaaggtgcggcgtaggtcg

SEQ ID NO: 38963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggattttaatcgcggaagttagatttatac

SEQ ID NO: 38964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcaaaacgtcaactgctattaaatagcga

SEQ ID NO: 38965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcaaacgtcgtttacgtattgcgcactga

SEQ ID NO: 38966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcaagcaataaggaatttgtccgtttctg

SEQ ID NO: 38967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcaagctatgaatcttcagttaaaacctg

SEQ ID NO: 38968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcaatcatctctgtcccgttagccgttgt

SEQ ID NO: 38969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcaatcggccagcagttaagactattgcg

SEQ ID NO: 38970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcacactgtcaccccattacgtccatgtc

SEQ ID NO: 38971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcacattccacatggcggacccaggctat

SEQ ID NO: 38972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcaccagacacgccgacttatgggccttt

SEQ ID NO: 38973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcacgaaaatattctataggctagtttct

SEQ ID NO: 38974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcacgaggaagcaagattgcaaggttcgc

SEQ ID NO: 38975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcacgcttctggccccttggcccgattag

SEQ ID NO: 38976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcacgggcatcgtaggatctctcagctcg

SEQ ID NO: 38977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcagaaccaaacaaaaacggccaccgata

SEQ ID NO: 38978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcagcccttgagtgcggataacgagtact

SEQ ID NO: 38979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcagcctgagcatttatgacgtggtcggg

SEQ ID NO: 38980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcagctagaggtctgcgagggatcaaagg

SEQ ID NO: 38981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcagctctggctgtattctggggtcggcg

SEQ ID NO: 38982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcaggaacggtttttagcaaaccctattg

SEQ ID NO: 38983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcaggggactcgggtgtttgtttcccgac

SEQ ID NO: 38984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcaggtcatacctaccaaaagcggctaca

SEQ ID NO: 38985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcagtgacgcacgactggtgaggttattc

SEQ ID NO: 38986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcagttgaatcagttcgctgcgtgcaggc

SEQ ID NO: 38987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcagttggggggttcggaacgtgcaggtc

SEQ ID NO: 38988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcataactgaggtggagtgtggccgctgc

SEQ ID NO: 38989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcatagactggttgtatggaactcatcat

SEQ ID NO: 38990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcatccccaccgggtatccaccctggatt

SEQ ID NO: 38991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcatcgctcttcaccctaacacttgtgcc

SEQ ID NO: 38992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggccaactccgcgacgaagggggtttattt

SEQ ID NO: 38993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggccaatcatggcgtgaggacgctgcggtc

SEQ ID NO: 38994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggccacaccgttgatgtttaggaactggtg

SEQ ID NO: 38995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggccaccctgccgtcatcacggagaccgcc

SEQ ID NO: 38996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggccactgccaagggcccgttgtcttccgg

SEQ ID NO: 38997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggccatggtgaccggccagcttacttcgca

SEQ ID NO: 38998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggccatttaatcgcggagggggcgttatgc

SEQ ID NO: 38999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcccagacgttcccatggcccacagtctg

SEQ ID NO: 39000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcccggttctaatatcacatgctacacat

SEQ ID NO: 39001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggccggatcacaccaaatcgcgtacttggt

SEQ ID NO: 39002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggccgtcgaaagctagccagaacgcataat

SEQ ID NO: 39003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcctcattgtcagtacgctgtaggttttc

SEQ ID NO: 39004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggccttgtcccggcaggggatcgcaaggtt

SEQ ID NO: 39005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgaacttgtcctcgattcacgttctatc

SEQ ID NO: 39006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgaccagaaggcaagtcaattctgtgac

SEQ ID NO: 39007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgaccgtacgttaacagtaatgccagcg

SEQ ID NO: 39008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgagcatctcataatagaacagccacat

SEQ ID NO: 39009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgagccaccggcacggcagacatccgtc

SEQ ID NO: 39010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgagtgtcttcattacatgcgcattccc

SEQ ID NO: 39011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgatcgagcggctatcgtgttaggtcgc

SEQ ID NO: 39012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgcaacactggttatgtccttccattac

SEQ ID NO: 39013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgcaacaggacgtcggttcatgcatccg

SEQ ID NO: 39014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgcacgcgcttagtgctgtagatcgtgt

SEQ ID NO: 39015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgcaggttgacaactagtgccttggaag

SEQ ID NO: 39016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgcattcactcccgttctcttgggacga

SEQ ID NO: 39017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgcccttgagcacaggaaaaggcaatcg

SEQ ID NO: 39018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgcggatcatgggtacagtgatctcgtg

SEQ ID NO: 39019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgctagcggagaaattggcgcgttctaa

SEQ ID NO: 39020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgctgcatgtgctgtatggtggggggcg

SEQ ID NO: 39021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcggcggctgctacactgttgatttccgt

SEQ ID NO: 39022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcggcttgttgaaatcggtcccatcgttc

SEQ ID NO: 39023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgggggggtcgggcgtattgctctcggt

SEQ ID NO: 39024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgggtaatcagtacatgctctgggttgg

SEQ ID NO: 39025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgtagattgaagttttatcgcgggcagt

SEQ ID NO: 39026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgtagtaccaggcgactcgcttcggatt

SEQ ID NO: 39027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgtgggtggcagcatgggcgcttggttt

SEQ ID NO: 39028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgtggtagccacgttcgtaaagttaggc

SEQ ID NO: 39029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcgtggtggcacatcagccgttaggtcgc

SEQ ID NO: 39030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctaacatgactctcaccttggtcacgcg

SEQ ID NO: 39031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctaacgagggggtcgtggtggatagctg

SEQ ID NO: 39032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctacagtacagggtacatacctcaagag

SEQ ID NO: 39033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctaccgcatcattgcctttgatacgtga

SEQ ID NO: 39034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctataactgatagttgttggtcacgtgg

SEQ ID NO: 39035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctcacaacgggcacctccacagcgtttt

SEQ ID NO: 39036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctcacgggatctgtacgtcgtgttcctc

SEQ ID NO: 39037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctccgaaagcgcacaggaggggcaagct

SEQ ID NO: 39038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctcggttggaggcatttatgttaaacta

SEQ ID NO: 39039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctcgtaccgggatcctgtgtgtagtctt

SEQ ID NO: 39040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctgaccaggaaagcaggcgtgcaacaat

SEQ ID NO: 39041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctgccagtacatgtatgcataggcaccg

SEQ ID NO: 39042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctgcgctgcgaactcggtatagcgccca

SEQ ID NO: 39043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctgctatccttattactgtccgtctgtg

SEQ ID NO: 39044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctggatggttgaccatatcgtccttggg

SEQ ID NO: 39045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctggtggttgaagcggcgcaaacgtttg

SEQ ID NO: 39046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctgtgaacgtcgtttggtggcgggctcg

SEQ ID NO: 39047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcttccgagggcggcgtatagaggttcgg

SEQ ID NO: 39048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcttctgcgaatgcgtgtgagtccaatgt

SEQ ID NO: 39049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctttcaacatacgacgcgcgattatctc

SEQ ID NO: 39050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggctttggaatatgtattcgccttagatgg

SEQ ID NO: 39051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggcttttaactcgtgatgatgtccgttaat

SEQ ID NO: 39052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggaaacggcaggctattctcacacccaag

SEQ ID NO: 39053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggaaagtgtccgcaacatgtattttacaa

SEQ ID NO: 39054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggaagagactaagggcgcaaagggcacgg

SEQ ID NO: 39055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggaaggtccggcagatccatttggttacg

SEQ ID NO: 39056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggaatattgcttgcaccgggttgcgcaga

SEQ ID NO: 39057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggacccgagaacgggatttagcagctcgt

SEQ ID NO: 39058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggaccggcaaaacatccggggcgtacgcg

SEQ ID NO: 39059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggacgagaagaatgtgggaggtggtaggc

SEQ ID NO: 39060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggacgaggctcccggcgcaggagggtgcg

SEQ ID NO: 39061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggacggttatccaagactcgcggcggcat

SEQ ID NO: 39062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggacgttcctactaacgcactctacctac

SEQ ID NO: 39063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggactccttctcgctaattgattgtttgt

SEQ ID NO: 39064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggacttggtgcttgagtttcccggctcgc

SEQ ID NO: 39065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggacttttagataaataagtgtggcttag

SEQ ID NO: 39066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggagatatccgacaaagacccggctctag

SEQ ID NO: 39067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggagggccaactggggcgtggtgtgggcg

SEQ ID NO: 39068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggaggtaacaggacggggtgtagcacggg

SEQ ID NO: 39069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggagtaagggttgtgtggatttctggacg

SEQ ID NO: 39070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggagttcggtcgcgaatgggtacacttca

SEQ ID NO: 39071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggatgccgctcttatcgtgtaactgtgtt

SEQ ID NO: 39072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggatgctgtgtgctagcgccattggatcg

SEQ ID NO: 39073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggatggcacggggaccgcagcgaactaag

SEQ ID NO: 39074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggatttaacctttcgcctagtgcgcctta

SEQ ID NO: 39075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcaagatcttaggtgacacaatcgctgt

SEQ ID NO: 39076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcaatagccagtgaccgctgagccaatt

SEQ ID NO: 39077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcactgctacctccgcgcaccgaaacat

SEQ ID NO: 39078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcagaggtgccggctccacttgcagctg

SEQ ID NO: 39079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcagtgaaagtttgtgtcttgtggtgga

SEQ ID NO: 39080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggccacaattgcgggagtagtaattagcc

SEQ ID NO: 39081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggccactccacatactcgttagccgtgat

SEQ ID NO: 39082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggccagaccgaggttgtggggctcagcct

SEQ ID NO: 39083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcccctgttgcaacagtctgtaaaggtg

SEQ ID NO: 39084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggccgaccagtgtatcacgtgtcgtgtct

SEQ ID NO: 39085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggccggactcgtatcatataacctgttgg

SEQ ID NO: 39086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcctcgactttaagttcccgcgcacatg

SEQ ID NO: 39087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcctgtgatacggttgtgcatctgtggc

SEQ ID NO: 39088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcgaaatatatttgttactcataacttg

SEQ ID NO: 39089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcgcggtcctcacatttgcgatctgttg

SEQ ID NO: 39090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcgcgtagttagcggagcgttcctgttc

SEQ ID NO: 39091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcggagagtcgcggttcacgaggacgca

SEQ ID NO: 39092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcggcgggacggcagtgatacgtagata

SEQ ID NO: 39093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcggctgacggcacgttaactagtctgt

SEQ ID NO: 39094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcgggacattccagcggaccgtcacgtc

SEQ ID NO: 39095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcgggtcggcggtgtacactcgagcggg

SEQ ID NO: 39096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcgttacaatcgcgtcaatccaggcatt

SEQ ID NO: 39097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcgttgcttcgctctcgtggttacgtgc

SEQ ID NO: 39098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcgttttttcattgttctgagggttgga

SEQ ID NO: 39099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggctacttattcttgctataacgttctgg

SEQ ID NO: 39100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggctagatcactctgtgaacgcgctgttt

SEQ ID NO: 39101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggctcccctggtaaagtcaggccccattg

SEQ ID NO: 39102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggctccgggaatcgcttcgcctagtagtg

SEQ ID NO: 39103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggctcgtagatggttctcacgacgtgctg

SEQ ID NO: 39104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggctcttggtttctcaatggcgtgaggtc

SEQ ID NO: 39105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggctgcattcggacgagtggtacggcttg

SEQ ID NO: 39106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcttaagctcttaaagtttctttgcgcc

SEQ ID NO: 39107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcttccagatcagcatacccatccgacc

SEQ ID NO: 39108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcttcggcgctgaagacaccggtttctg

SEQ ID NO: 39109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggctttcggctgccagcggtcgcgtagtg

SEQ ID NO: 39110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggcttttgcactggtcgatcgagcgcggt

SEQ ID NO: 39111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggaagcagcctctccgtggtcgcgttat

SEQ ID NO: 39112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggacggcttgaggttcaaacaggcccct

SEQ ID NO: 39113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggactggagcatcgttctaacgcacttt

SEQ ID NO: 39114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggagaagtggtgagtgggactgtaagaa

SEQ ID NO: 39115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggatacggcacgctgatttgtcgttggt

SEQ ID NO: 39116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggatgatcccgtaaacggtgctaagttg

SEQ ID NO: 39117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggcaccgtgtggtgaaccgttaattctc

SEQ ID NO: 39118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggcccggaataggtcacgggtctttcgg

SEQ ID NO: 39119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggccggggctaggcggctaaggcaatgc

SEQ ID NO: 39120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggcctgcagactgctgttttgacctgtc

SEQ ID NO: 39121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggcgagctccacgggggatttggtaagg

SEQ ID NO: 39122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggcgatccaggaatgcgtccacttcacc

SEQ ID NO: 39123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggcgccatctcttcatacttccgtgctg

SEQ ID NO: 39124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggcgcgatgggctaagtcgtaccttagt

SEQ ID NO: 39125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggcgtatgggacctttgctcaccacagc

SEQ ID NO: 39126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggcgtcgatcttttgcactacttgcgat

SEQ ID NO: 39127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggctaggccagatacttagaggatccgt

SEQ ID NO: 39128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggctctgtttgtccgcatgttctctggc

SEQ ID NO: 39129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggctggttaagatagtgacgagcgtacg

SEQ ID NO: 39130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggctttaggttgggacgaacgggaagtt

SEQ ID NO: 39131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggggacaccgttcccaccggttcgactgc

SEQ ID NO: 39132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggggaggcgataatctttggctttagatc

SEQ ID NO: 39133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggggatttcagtgggggtcctgcgggtgt

SEQ ID NO: 39134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggggcacatgtgaacgtggatattcatta

SEQ ID NO: 39135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggggcttgtatgcgtttgattattatcct

SEQ ID NO: 39136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggggaggcctattgatcacgatggtcgg

SEQ ID NO: 39137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggggcgagcataacggtaaatccaatgc

SEQ ID NO: 39138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggggcgcaaggcggtgagtggcaagtca

SEQ ID NO: 39139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggggggtaccgaagcatgccgagccacgc

SEQ ID NO: 39140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggtacacgtcttcgccggttgtatgtgg

SEQ ID NO: 39141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggtcgcgcgcacgtactcagggacggcg

SEQ ID NO: 39142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggtctgggatgttggcttgtgtggaagt

SEQ ID NO: 39143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggtgggttatcggcgtcgtctttgtttg

SEQ ID NO: 39144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggttcagtcatgccgtagtgacctcttt

SEQ ID NO: 39145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggggttgcacatgataacggccgccctcga

SEQ ID NO: 39146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggtacgcggcgagatggaaaaagccaagc

SEQ ID NO: 39147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggtatcattgaatgtggggtccggatctg

SEQ ID NO: 39148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggtatgcgtgctcgtcttgtaggtcatat

SEQ ID NO: 39149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggtcacggtactgccgcgagaggacgtac

SEQ ID NO: 39150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggtcaggaggcgagttgtgcaattccgtg

SEQ ID NO: 39151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggtcagggactatgatgattcgaaccgga

SEQ ID NO: 39152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggtccgaagttatcgtctggtctccttag

SEQ ID NO: 39153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggtccgagtatgctagctcataaggcagc

SEQ ID NO: 39154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggtccgtcttgctctgtgattctgttcgt

SEQ ID NO: 39155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggtctctaggaaaagcactcggtttcgta

SEQ ID NO: 39156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggtgcccttcttggcttttccgccctagt

SEQ ID NO: 39157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggtggcggcgtcgtgacgttcgaggcatg

SEQ ID NO: 39158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggtggctatgatataccggatgtgcgcaa

SEQ ID NO: 39159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggtggtcagcgtatcggtgacatcggcgt

SEQ ID NO: 39160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggttacggcagtttggaactaacgcacat

SEQ ID NO: 39161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggttaggcgattgatattggctcccgggg

SEQ ID NO: 39162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggttagttagacgcggtttaggaaacgga

SEQ ID NO: 39163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggttcccgtcgccgaagttctatccagac

SEQ ID NO: 39164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggttccgtcagcatacgtgatgtgtgtcc

SEQ ID NO: 39165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggttgatgtggaggcctatacgttacgca

SEQ ID NO: 39166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggttgcggtatggcacgcagatggtctat

SEQ ID NO: 39167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggtttcacaatgttatgagcgtcgccgca

SEQ ID NO: 39168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggttttagtcacgctcacatttccgaacg

SEQ ID NO: 39169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagggttttgctgtgcggtaaactccgttggt

SEQ ID NO: 39170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtaacaacgaaagcttgacggtcatcatg

SEQ ID NO: 39171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtaagcaaccgcaccaagggatcggattc

SEQ ID NO: 39172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtaaggcataggtgtccgatatgcgatgt

SEQ ID NO: 39173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtaatttgattcggaaggtgtacttatgg

SEQ ID NO: 39174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtacaatgttatcgtcctcgaatgtatta

SEQ ID NO: 39175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtacataattactcgagtggccgttccga

SEQ ID NO: 39176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtacattgggcacctcacgggacaatgct

SEQ ID NO: 39177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtaccatattatcactcctggcctcggcg

SEQ ID NO: 39178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtacccagtcgtttctgcgacctagaact

SEQ ID NO: 39179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtaccgggaatgctcggctcagggcggtg

SEQ ID NO: 39180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtaccgttacgcagctccgtctatgcccg

SEQ ID NO: 39181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtacgaccgacgattggctccataactat

SEQ ID NO: 39182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtacgcagtaggtgttgttttccttcccg

SEQ ID NO: 39183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtacgccctaagtgacgatgcctgaactc

SEQ ID NO: 39184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtacgtcgtgcgtcaagcttgtagccgtg

SEQ ID NO: 39185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtagcgcgccttgcttacccttgcctctg

SEQ ID NO: 39186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtagcgcgtgaggaaccacataatggtca

SEQ ID NO: 39187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtagcgggtaatgatactctaacccgtgt

SEQ ID NO: 39188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtaggtacatcccggcggtaccacaggtg

SEQ ID NO: 39189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtatgcctagtgcggtatcggaggaggtc

SEQ ID NO: 39190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtcactatttgcgtagggatttcagatac

SEQ ID NO: 39191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtcaggttaccgttttcaccaggctctgc

SEQ ID NO: 39192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtcatcaaatagcggaccgctggcgttag

SEQ ID NO: 39193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtcatctagaagtttagggttcaacagct

SEQ ID NO: 39194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtccaatgggaaccggcgaacggctgcca

SEQ ID NO: 39195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtcccgccgcttgttacagttcgttcccg

SEQ ID NO: 39196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtcccgcgctctcgggtgaaagggtacca

SEQ ID NO: 39197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtccggactccaattgttcgatggagcgt

SEQ ID NO: 39198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtccttctgatgcgtgtcacctttgcgca

SEQ ID NO: 39199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtcgaaaataaccccacaattgtaggcaa

SEQ ID NO: 39200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtcgacttggccatgccgccgatcagcgc

SEQ ID NO: 39201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtcgggtggtcactcgtttcatataagca

SEQ ID NO: 39202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtcgtcgtggtgtcccggaggccatgagg

SEQ ID NO: 39203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtctagctcgccaaatacaccatgtcaca

SEQ ID NO: 39204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtctgggtaggtcgcttgcacaccacaac

SEQ ID NO: 39205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtctttcctttgagatcatctccccggcg

SEQ ID NO: 39206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgaaagtgtgcacaaaatgacagcggtt

SEQ ID NO: 39207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgactgcaggcggccagaagaagctttc

SEQ ID NO: 39208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgactgctcgttgctgattcggttactt

SEQ ID NO: 39209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgaggaggccgaaccggggggtccccgt

SEQ ID NO: 39210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgaggggtggcgctttgtctctcggagc

SEQ ID NO: 39211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgatggtctagcagccccaggagccgtt

SEQ ID NO: 39212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgattagtcggtgcggctcacttatagg

SEQ ID NO: 39213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgattgaggatcgcggagtggtatgctt

SEQ ID NO: 39214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgcactgatccgagggccgtgtgatttg

SEQ ID NO: 39215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgcagatgggactaacatcctattccat

SEQ ID NO: 39216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgcgggatcgtgcggtctagattggtgc

SEQ ID NO: 39217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgcgtcggaccggagggatccgccttac

SEQ ID NO: 39218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgctcgacttctattatacggcgaattg

SEQ ID NO: 39219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtggcgcggttccctggggactccgatta

SEQ ID NO: 39220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtggcgcgtgtattggatggcggctagga

SEQ ID NO: 39221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgggaaacatggtgatctcatttggata

SEQ ID NO: 39222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgggaggaaccatcgcacaggggctcgt

SEQ ID NO: 39223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtggtctcgagaggtcgatacataacggt

SEQ ID NO: 39224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtggtgcgctacacaagtggcgttatgag

SEQ ID NO: 39225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtggtgggaatccaggcactgtaatcaag

SEQ ID NO: 39226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgtaatagtactccattgcgtccgcccg

SEQ ID NO: 39227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgtctccgccttttcttctcgggttttc

SEQ ID NO: 39228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgtctcgcttaacactatccgcccacgt

SEQ ID NO: 39229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgtctgaacccacctcaccggagacgat

SEQ ID NO: 39230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgtgcaaaagcgacctggccccgtagga

SEQ ID NO: 39231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggtgtggtggagttgtttcctgagatttgt

SEQ ID NO: 39232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggttaagatgtgggtacatcgacagcccgc

SEQ ID NO: 39233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggttaatgtatcgtgttacctggggtgttt

SEQ ID NO: 39234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggttaggccatcgtatttttacatttcctc

SEQ ID NO: 39235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggttagttacgatgggcaagctccgaacat

SEQ ID NO: 39236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggttcatactctgattttggctctcacttt

SEQ ID NO: 39237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggttcgtgcggaagtctgtgtggtgcgcgc

SEQ ID NO: 39238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggttcgttcggcgctacttggaatcttgtg

SEQ ID NO: 39239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggttgccgtggtccgggatgcgtgattggg

SEQ ID NO: 39240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggttgggattcttcgaggcgagaccgtggg

SEQ ID NO: 39241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggttgggggcacatctgccgcgtcgaaggt

SEQ ID NO: 39242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggttgtaagctacttatatgtatgggaaag

SEQ ID NO: 39243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gaggttgtcatcccatgcgtgttctccaggga

SEQ ID NO: 39244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtaacagatacacaagagtaggagctgtac

SEQ ID NO: 39245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtaaccgatccccgtttattggagccgctg

SEQ ID NO: 39246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtaagttcacccctcgggtgtccccttatg

SEQ ID NO: 39247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtaatgggacggtccggtcggcacttagtc

SEQ ID NO: 39248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtacacaactgagtgctctttcccgggcgc

SEQ ID NO: 39249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtacacctagacaagagcatcttcgaggtc

SEQ ID NO: 39250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtacagcaacctaagttccaccaagtgtta

SEQ ID NO: 39251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtaccaactcctctggacatggtgaagctg

SEQ ID NO: 39252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtacctaacgcggggacaatatgggtgcac

SEQ ID NO: 39253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtacgcgtgctgcttgacgtgtcattgcgt

SEQ ID NO: 39254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtacgggaatgggcctgctattatcggtgc

SEQ ID NO: 39255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtacggtcggtggaacggcaacagcttccc

SEQ ID NO: 39256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtacgttgtaggctctcccggcaggggtcg

SEQ ID NO: 39257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtagacgaatatcgctggtcagtggacccg

SEQ ID NO: 39258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtagacgacgatggagcttcggctagtgcc

SEQ ID NO: 39259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtagagttcagtatatcgggttcctctaag

SEQ ID NO: 39260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtagccactggctgactgcggtgctgggct

SEQ ID NO: 39261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtagccgtgttgggcgtgtgcccgggacta

SEQ ID NO: 39262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtagcgaccttgtgccgggaccccgcttct

SEQ ID NO: 39263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtagtcccggggttagagtattcgaacggt

SEQ ID NO: 39264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtagtgggtgatagacgtccgttctaagta

SEQ ID NO: 39265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtataatgagctagaatcactcgccggctg

SEQ ID NO: 39266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtatagtttacaaggtcaaacttaaccagc

SEQ ID NO: 39267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtatcgaaggtaccgcacgcgtgatggtgt

SEQ ID NO: 39268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtatcgcccagcgggttgggtaccggaacc

SEQ ID NO: 39269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtatcggggtgtgttcggcgttggattgga

SEQ ID NO: 39270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtatgccattgtcgttttagtgtcttgata

SEQ ID NO: 39271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtatgcccgctgcccactggataggtgccg

SEQ ID NO: 39272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtatggataagtggctattaagtgcagttg

SEQ ID NO: 39273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtatggcagggtgcggtcacggctggtcgc

SEQ ID NO: 39274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtattaagtcttatgggtcctatcggcacc

SEQ ID NO: 39275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtcaaggctggtacgccgcatgttttaatg

SEQ ID NO: 39276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtcaagggtcgtgccacacgtcttaggcgg

SEQ ID NO: 39277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtcacgcatagacaggagttatcagggtag

SEQ ID NO: 39278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtcatcatggaagcgggctcagggtcggct

SEQ ID NO: 39279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtcatgcaacggtccattggggtgtgagcg

SEQ ID NO: 39280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtcattactgtgtgtcgtaagtggtggtcg

SEQ ID NO: 39281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtcatttcgggtcaatccgtcgcctgttcc

SEQ ID NO: 39282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtccacaccttctagtacctcgacctgctt

SEQ ID NO: 39283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtccataccagaatgaagggtctaggtgtc

SEQ ID NO: 39284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtcccctccaataaccccgttgtaattgtc

SEQ ID NO: 39285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtccgcaagcacgcgtagcggccagagcct

SEQ ID NO: 39286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtccgggaagcgggtgtcgggcgaggtcat

SEQ ID NO: 39287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtcctgacttaggatgggactgttgtttcc

SEQ ID NO: 39288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtcggcgttgtctgtccacatttggccggt

SEQ ID NO: 39289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtcgtcatcacacgtagcgagataccccgg

SEQ ID NO: 39290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtcgtggcattgttataggcatgctgagtt

SEQ ID NO: 39291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtctaagtcactcaatcccagctatctcgg

SEQ ID NO: 39292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtctacataaattaaagcggtttacacttg

SEQ ID NO: 39293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtctcaagtgtgcggtgagactgcggccgg

SEQ ID NO: 39294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtctctacagtcgcgatacagtttttcatc

SEQ ID NO: 39295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtctgcaccgacggtagttttatatggact

SEQ ID NO: 39296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtctggtcgttgacgtggtactcgttgtgg

SEQ ID NO: 39297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtctgtttgtaataattgcaataccggctt

SEQ ID NO: 39298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtcttatctctgtagctggttggtggttgt

SEQ ID NO: 39299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtcttgaagtgccgcgcctacgtgagctat

SEQ ID NO: 39300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgaaggtggctgccgacgctttaagaggc

SEQ ID NO: 39301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgaagttcgaggcaacgcacagacatacg

SEQ ID NO: 39302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgaccacgcgtaccgttcctggtgtgcgc

SEQ ID NO: 39303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgacgctcgaaacattgtcattcgttacc

SEQ ID NO: 39304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgacttgttagacctgcgttcaacggcgg

SEQ ID NO: 39305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgagcgagccgaattccgtaccaccggga

SEQ ID NO: 39306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgagcgtcgtggtttgtgcaccagtgacg

SEQ ID NO: 39307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgaggagtttacgcccatctgtgcccgct

SEQ ID NO: 39308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgattactgcagtttcacggctaactgta

SEQ ID NO: 39309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgattcgcgcggcgtttattggctctttc

SEQ ID NO: 39310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgcaagttgcgtggtaagccggcgagagt

SEQ ID NO: 39311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgcacgtaagctgcgaagggatggacttc

SEQ ID NO: 39312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgcagataccaatcatgttaacagcatgt

SEQ ID NO: 39313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgcataacacgggttcggacctaaagctg

SEQ ID NO: 39314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgcatttcccggaacttcaccctcaggaa

SEQ ID NO: 39315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgcccgcgctagccctggaaccaggacgg

SEQ ID NO: 39316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgcgaaaacgtaaacctctcgcgcttgtg

SEQ ID NO: 39317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgcgatgcgataatggtctacacagatcg

SEQ ID NO: 39318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgcgcatttgctcgggttgtttgatgttg

SEQ ID NO: 39319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgcgccaactagactatgccattaagcga

SEQ ID NO: 39320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgcgggtggttcatagactctgactgaac

SEQ ID NO: 39321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgctaattagctctgacatgcactgaact

SEQ ID NO: 39322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgctagtcgcttggacacgtacggaactc

SEQ ID NO: 39323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtggaacatcagttagccagggctgtcctg

SEQ ID NO: 39324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtggacacgaaccaacggtgcgtattgcac

SEQ ID NO: 39325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtggaccgataccacccgcccttttacgcc

SEQ ID NO: 39326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtggcagcggggctgtcgaggatggagcgg

SEQ ID NO: 39327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtggcctaggcaatgcgcattacagcgtcg

SEQ ID NO: 39328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtggcgatattacgcgacacagtttgccaa

SEQ ID NO: 39329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtggctttttcgcggctagttgacgacccg

SEQ ID NO: 39330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgggactgacgttgtaaaactactcttct
